United States Patent
Heinz et al.

(10) Patent No.: US 11,692,002 B2
(45) Date of Patent: Jul. 4, 2023

(54) RNA SEQUENCE ADAPTATION

(71) Applicant: CureVac SE, Tübingen (DE)

(72) Inventors: Stefan Heinz, Tübingen (DE); Tilmann Roos, Tübingen (DE); Dominik Vahrenhorst, Tübingen (DE); Markus Conzelmann, Tübingen (DE)

(73) Assignee: CureVac SE, Tübingen (DE)

( * ) Notice: Subject to any disclaimer, the term of this patent is extended or adjusted under 35 U.S.C. 154(b) by 0 days.

(21) Appl. No.: 16/762,081

(22) PCT Filed: Nov. 8, 2018

(86) PCT No.: PCT/EP2018/080692
§ 371 (c)(1),
(2) Date: May 6, 2020

(87) PCT Pub. No.: WO2019/092153
PCT Pub. Date: May 16, 2019

(65) Prior Publication Data
US 2022/0144877 A1    May 12, 2022

(30) Foreign Application Priority Data
Nov. 8, 2017   (WO) ................. PCT/EP2017/078647

(51) Int. Cl.
C07H 1/06    (2006.01)
A61K 31/713  (2006.01)
C12Q 1/68    (2018.01)

(52) U.S. Cl.
CPC ............. *C07H 1/06* (2013.01); *A61K 31/713* (2013.01)

(58) Field of Classification Search
None
See application file for complete search history.

(56) References Cited

U.S. PATENT DOCUMENTS

| | | |
|---|---|---|
| 2002/0153312 A1 | 10/2002 | Gjerde et al. |
| 2005/0032730 A1 | 2/2005 | von der Mülbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0054005 A1 | 3/2011 | Naito et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |

(Continued)

FOREIGN PATENT DOCUMENTS

| | | |
|---|---|---|
| CN | 106 442 827 | 2/2017 |
| RU | 2595374 | 8/2016 |

(Continued)

OTHER PUBLICATIONS

Azarani et al. Nucleic Acids Research vol. 29, No. 2 e7, 2001.*
Morelle et al., "Restructuring the translation initiation region of the human parathyroid hormone gene for improved expression in *Escherichia coli*," *Biochim Biophys Acta.*, 1089(3):320-324, 1991.
PCT International Search Report and Written Opinion issued in International Application No. PCT/EP2018/080692, dated Dec. 17, 2018.

(Continued)

*Primary Examiner* — Sean McGarry
(74) *Attorney, Agent, or Firm* — Parker Highlander PLLC

(57) ABSTRACT

The present invention is directed to a method for modifying the retention time of RNA on a chromatographic column. The present invention also concerns a method for purifying RNA from a mixture of at least two RNA species. Furthermore, the present invention relates to a method for co-purifying at least two RNA species from a mixture of at least two RNA species. In particular, the present invention provides a method for harmonizing the numbers of A and/or U nucleotides in at least two RNA species. The present invention is also directed to RNA obtainable by said methods, a composition comprising said RNA or a vaccine comprising said RNA and methods for producing such RNA and compositions. Further, the invention concerns a kit, particularly a kit of parts, comprising the RNA, composition or vaccine. The invention is further directed to a method of treating or preventing a disorder or a disease, first and second medical uses of the RNA, composition and vaccine. Moreover, the present invention concerns a method for providing an adapted RNA sequence or an adapted RNA mixture.

22 Claims, 21 Drawing Sheets
Specification includes a Sequence Listing.

(56) References Cited

U.S. PATENT DOCUMENTS

| | | |
|---|---|---|
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe et al. |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |
| 2019/0381180 A1 | 12/2019 | Baumhof et al. |
| 2020/0023076 A1 | 1/2020 | Fotin-Mleczek et al. |
| 2020/0085852 A1 | 3/2020 | Fotin-Mleczek |
| 2020/0085944 A1 | 3/2020 | Heidenreich et al. |
| 2020/0149026 A1 | 5/2020 | Horscroft et al. |
| 2020/0163878 A1 | 5/2020 | Baumhof et al. |
| 2020/0179526 A1 | 6/2020 | Baumhof et al. |
| 2020/0318097 A1 | 10/2020 | Funkner et al. |
| 2020/0392572 A1 | 12/2020 | Yazdan Panah et al. |
| 2021/0030864 A1 | 2/2021 | Petsch et al. |
| 2021/0069315 A1 | 3/2021 | Baumhof et al. |
| 2021/0162037 A1 | 6/2021 | Jasny et al. |
| 2021/0170017 A1 | 6/2021 | Lutz et al. |
| 2021/0180106 A1 | 6/2021 | Wochner et al. |
| 2021/0205434 A1 | 7/2021 | Petsch et al. |
| 2021/0260178 A1 | 8/2021 | Jasny et al. |
| 2021/0261897 A1 | 8/2021 | Yazdan Panah et al. |
| 2021/0361761 A1 | 11/2021 | Lutz et al. |
| 2021/0379181 A1 | 12/2021 | Rauch et al. |
| 2021/0403925 A1 | 12/2021 | Chevessier-Tünnesen et al. |
| 2022/0040281 A1 | 2/2022 | Schwendt et al. |
| 2022/0073962 A1 | 3/2022 | Schwenger et al. |

FOREIGN PATENT DOCUMENTS

| | | |
|---|---|---|
| WO | WO 2016/193206 | 12/2016 |
| WO | WO 2018/211038 | 11/2018 |
| WO | WO 2019/077001 | 4/2019 |
| WO | WO 2019/092153 | 5/2019 |
| WO | WO 2020/123300 | 6/2020 |
| WO | WO 2020/161342 | 8/2020 |
| WO | WO 2020/254535 | 12/2020 |
| WO | WO 2021/028439 | 2/2021 |
| WO | WO 2021/239880 | 12/2021 |

OTHER PUBLICATIONS

Vu et al., "C-to-U editing and site-directed RNA editing for the correction of genetic mutations," *Bioscience Trends*, 11(3):243-253, 2017.

\* cited by examiner

RNA SEQUENCE ADAPTATION

This application is a national phase application under 35 U.S.C. § 371 of International Application No. PCT/EP2018/080692, filed Nov. 8, 2018, which claims benefit of International Application No. PCT/EP2017/078647, filed Nov. 8, 2017, the entire contents of each of which are hereby incorporated by reference.

INTRODUCTION

The present invention is directed to a method for modifying the retention time of RNA on a chromatographic column. The present invention also concerns a method for purifying RNA from a mixture of at least two RNA species. Furthermore, the present invention relates to a method for co-purifying at least two RNA species from a mixture of at least two RNA species. In particular, the present invention provides a method for harmonizing the numbers of A and/or U nucleotides in at least two RNA species. The present invention is also directed to RNA obtainable by said methods, a composition comprising said RNA or a vaccine comprising said RNA and methods for producing such RNA and compositions. Further, the invention concerns a kit, particularly a kit of parts, comprising the RNA, composition or vaccine. The invention is further directed to a method of treating or preventing a disorder or a disease, first and second medical uses of the RNA, composition and vaccine. Moreover, the present invention concerns a method for providing an adapted RNA sequence or an adapted RNA mixture.

Ribonucleic acid (RNA)-based therapeutics can be used in immunotherapy, gene therapy and genetic vaccination. They can provide highly specific and individual treatment options for the therapy of a large variety of diseases.

For certain medical treatments and applications, it is desired to apply an RNA mixture comprising different RNA molecule species. Examples of such treatments based on an RNA mixture include the application of polyvalent RNA mixtures that provide protection against several serotypes of a pathogen (e.g. hemagglutinin (HA) from multiple serotypes of Influenza A and B virus); RNA mixtures that provide different antigens from one pathogen (e.g. different antigens from Influenza, such as HA, nucleoprotein (NP), neuraminidase (NA) etc.); RNA mixtures that provide protection against several isoforms or variants of a cancer antigen (e.g. prostate specific antigen (PSA) in the context of prostate carcinoma); RNA mixtures that provide different epitopes of an antigen; RNA mixtures that contain a cancer specific and/or patient specific mixture of cancer antigens (expressed antigens or mutated antigens); RNA mixtures that encode a variety of antibodies (e.g., antibodies that are targeted against different epitopes of one or more proteins), or any other therapeutically active RNA mixture (e.g., encoding different isoforms of an enzyme for molecular therapy, different therapeutic proteins for treatment of an indication wherein several proteins have to be supplemented).

A significant step forward in the field of RNA-based therapeutics was achieved by the establishment of an RNA manufacturing process that has been approved by regulatory authorities, implementing various quality controls on DNA level and RNA level as described in detail in WO2016/180430A1. A key element of said process is the preparative purification of the RNA product via RP-HPLC (as described in WO 2008/077592A1).

So far, RNA production methods are, however, only suitable to produce one single specific RNA molecule species at a time, such as an RNA molecule encoding one specific therapeutic target. Each RNA molecule species has to be produced in a separate production process. For the production of an RNA mixture comprising different RNA molecule species, separate production processes have to be performed, and the separately produced RNA molecule species have to be mixed to generate an RNA mixture. Accordingly, the conventional production of an RNA mixture (e.g. polyvalent vaccine) containing several RNA molecule species (e.g. RNA coding for different antigens, e.g. Influenza virus antigens) is laborious, costly, and time consuming since it requires several runs for DNA template production, RNA production and HPLC purification of the RNA product. Apart from economic reasons, especially in the context of pandemic scenarios, an acceleration of the production of RNA mixtures (e.g. polyvalent RNA vaccine) may be highly advantageous and of major importance for public health. Therefore, it is desirable to produce and purify RNA mixtures simultaneously, ideally in only one production and purification process.

Simultaneous production, purification, and analysis of RNA mixtures are of particular importance for the manufacturing of multivalent/polyvalent vaccines, particularly a multivalent/polyvalent influenza RNA vaccine. Advantageously, the manufacturing of such a multivalent/polyvalent influenza RNA vaccine should allow for a fast exchange of (one or many) antigens (e.g. for seasonal adaptations of the vaccine; pandemic scenario) without changing the conditions for key processes of production (e.g., purification, analysis etc.).

Recently, a procedure for the simultaneous production of different RNA molecule species in one production process has been developed, as described in WO20171090134, aiming to economize and accelerate the production of RNA mixture based therapeutics.

Simultaneous production of different RNA molecule species as e.g. described in WO20171090134 would save time, labor costs, production costs, and production capacities (e.g., space, equipment) in the manufacturing of RNA mixture based therapeutics. However, a severe problem is associated with the use of RP-HPLC for simultaneous preparative purification of the obtained RNA mixture (herein also referred to as "co-purification"). Different RNA molecule species in an RNA mixture commonly elute at different time points (due to different retention time in HPLC), which renders co-purification via HPLC technically impossible in most of the cases (illustrated in FIGS. 1A and B). For example, co-purification via HPLC would only be possible in cases, where all different RNA molecule species comprised in the RNA mixture elute at essentially the same time point leading to an overlay of the different RNA product peaks facilitating separation of clean full-length RNA product mixture (peak fraction) and separation from impurities (illustrated in FIGS. 1C and D).

Accordingly, the purification of an RNA-mixture, such as an RNA-based therapeutic comprising multiple RNA species (e.g. a multivalent RNA vaccine), is not feasible with the current methodology known in the art. In particular, the co-purification of individual RNA species in an RNA mixture is not feasible. However, such a co-purification is highly desirable, for example in the context of the development of a multivalent/polyvalent influenza RNA vaccine platform that is capable of being adapted to seasonal changes in the antigen composition. In such a situation, rapid exchanges of antigens (e.g. influenza hemagglutinin (HA) and/or neuraminidase (NA)) are required. The methods available in the field do not allow for the co-purification of different RNA species from an RNA mixture, in particular via HPLC, since different species of RNA molecules encoding different antigens would typically elute at different time points.

For similar reasons, also simultaneous HPLC-based quality control of RNA mixtures or (multivalent) vaccine (either produced in one production process or individually produced and mixed) is not feasible when using prior art techniques. For the analysis of therapeutics comprising mixtures of RNAs, it is required that the different components (i.e. different RNA molecule species) of the drug product can be characterized in terms of presence, integrity, ratio and quantity (quality control parameter). Such quality controls may be implemented during or following production of the RNA mixture, and/or as a batch release quality control. However, as described above, different species of RNA molecules in an RNA mixture typically elute at different time points, which strongly impedes the simultaneous assessment of the quality/integrity of the individual RNA molecule species/or the whole RNA mixture via HPLC ("co-analysis") (illustrated in FIGS. 1A and B). A reliable determination of the integrity of the RNA mixture via HPLC would only be possible in cases where the clear discrimination of the peak areas for each RNA molecule species is possible (simultaneous determination of the RNA quality for each RNA molecule species; see FIG. 1E) and/or where different RNA species in the RNA mixture elute at essentially the same time point, leading to an essentially complete overlay of the HPLC peaks (determination of the RNA quality of the whole RNA mixture; see FIGS. 1C and D).

Accordingly, also the analysis of an RNA mixture, such as an RNA therapeutic comprising multiple RNA species (e.g. a multivalent Influenza RNA vaccine), is not feasible with the current methodology provided in the art. In particular, co-analysis of RNA species in an RNA mixture is not possible. For example, co-analysis, e.g. via HPLC, is not applicable in the case of a multivalent RNA vaccine platform, where rapid exchanges of antigens are required (e.g. for seasonal vaccines, such as an influenza vaccine), since different species of RNA molecules each encoding different antigens (such as Influenza HA and/or NA) elute at different time points, typically leading to partially overlapping HPLC peaks.

In summary, the technical difficulties described above strongly hinder the (co-)purification and the (co-)analysis of RNA mixtures. In particular, RP-HPLC, which represents a key element for the purification and the analysis of RNA in general and particularly of GMP-grade RNA, cannot be employed in the (co-)purification and (co-)analysis of individual RNA species in RNA mixtures. Furthermore, the described problems have to be solved to facilitate the development of a multivalent/polyvalent RNA manufacturing process for producing fast-adjustable RNA vaccines, e.g. influenza vaccines Summarizing the above, there remains an unmet need for a system that allows for purification and/or analysis of RNA mixtures.

Therefore, it is the object of the underlying invention to provide a system for purification and/or analysis of RNA, in particular of an RNA mixture. It is further a preferred object of the present invention to provide a system for (co-)purification and/or (co-)analysis of individual RNA species in an RNA mixture comprising multiple RNA species.

This object is solved by the claimed subject matter.

DESCRIPTION OF THE INVENTION

The present application is filed together with a sequence listing in electronic format, which is part of the description of the present application. The information contained in the electronic format of the sequence listing filed together with this application is incorporated herein by reference in its entirety. Where reference is made herein to a 'SEQ ID NO:' the corresponding nucleic acid sequence or amino acid sequence in the sequence listing having the respective identifier is referred to, unless stated otherwise.

For the sake of clarity and readability the following definitions are provided. Any technical feature mentioned for these definitions may be read on each and every embodiment of the invention. Additional definitions and explanations may be specifically provided in the context of these embodiments.

Definitions

Adaptive immune response: The term "adaptive immune response" as used herein will be recognized and understood by the person of ordinary skill in the art, and is, for example, intended to refer to an antigen-specific response of the immune system. Antigen specificity allows for the generation of responses that are tailored to specific pathogens or pathogen-infected cells. The ability to mount these tailored responses is usually maintained in the body by "memory cells" (B-cells). In the context of the invention, the antigen is provided by the RNA coding region encoding at least one antigenic peptide, or protein.

Adaptive immune system: The adaptive immune system is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered.

Adjuvant/adjuvant component: An adjuvant or an adjuvant component in the broadest sense is typically a pharmacological and/or immunological agent that may enhance the effect of other agents, such as a drug or vaccine. It is to be interpreted in a broad sense and refers to a broad spectrum of substances. Typically, these substances are able to increase the immunogenicity of antigens. For example, adjuvants may be recognized by the innate immune systems and, e.g., may elicit an innate immune response. "Adjuvants" typically do not elicit an adaptive immune response. Insofar, "adjuvants" do not qualify as antigens. Their mode of action is distinct from the effects triggered by antigens resulting in an adaptive immune response.

Antigen: In the context of the present invention "antigen" refers typically to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. In the sense of the present invention an antigen may be the product of translation of a provided RNA as defined herein. In this context, also fragments, variants and derivatives of peptides and proteins comprising at least one epitope are understood as antigens. In the context of the present invention, tumor antigens and pathogenic antigens as defined herein are particularly preferred.

Bicistronic RNA, multicistronic RNA: A bicistronic or multicistronic RNA is typically an RNA, preferably an mRNA, that typically may have two (bicistronic) or more (multicistronic) coding regions. A coding region in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component.

Cationic component: The term "cationic component" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic peptide or protein which is positively charged under physiological conditions, particularly under physiological conditions in vivo. A "cationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the conditions given.

Coding region: A coding region, in the context of the invention, is typically a sequence of several nucleotide triplets, which may be translated into a peptide or protein. A coding region preferably contains a start codon, i.e. a combination of three subsequent nucleotides coding usually for the amino acid methionine (ATG), at its 5'-end and a subsequent region which usually exhibits a length which is a multiple of 3 nucleotides. A coding region is preferably terminated by a stop-codon (e.g., TAA, TAG, TGA). Typically, this is the only stop-codon of the coding region. Thus, a coding region in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The coding region may be isolated or it may be incorporated in a longer nucleic acid sequence, for example in a vector or an mRNA. In the context of the present invention, a coding region may also be termed "protein coding region", "coding sequence", "CDS", "open reading frame" or "ORF".

Fragment of a sequence: A fragment of a sequence may typically be a shorter portion of a full-length sequence of e.g. a nucleic acid molecule or an amino acid sequence. Accordingly, a fragment, typically, comprises or consists of a sequence that is identical to the corresponding stretch within the full-length sequence. A preferred fragment of a sequence in the context of the present invention, comprises or consists of a continuous stretch of entities, such as nucleotides or amino acids corresponding to a continuous stretch of entities in the molecule the fragment is derived from, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) molecule from which the fragment is derived. Preferably, a fragment of a sequence as used herein is at least 5%, 10%, 20%, 30%, 40%, 50%, 60%, preferably at least 70%, more preferably at least 80%, even more preferably at least 90%, even more preferably at least 95%, most preferably at least 99%, identical to a sequence, from which it is derived. Preferably, a fragment as used herein has the same biological function or specific activity compared to the full-length molecule.

Heterologous sequence: Two sequences are typically understood to be 'heterologous' if they are not derivable from the same gene or in the same allele. I.e., although heterologous sequences may be derivable from the same organism, they naturally (in nature) do not occur in the same nucleic acid molecule, such as in the same mRNA.

Homolog (of a nucleic acid sequence/amino acid sequence): The term "homolog" typically refers to a sequence of the same or of another species that is related, but preferably not identical, to a reference sequence. The term "homolog" encompasses orthologs as well as paralogs. In this context, "orthologs" are proteins encoded by genes in different species that evolved from a common ancestral gene by speciation. Orthologs often retain the same function(s) in the course of evolution. Thus, functions may be lost or gained when comparing a pair of orthologs. "Paralogs" are genes produced via gene duplication within a genome. Paralogs may also evolve new functions or eventually become pseudogenes. In the context of the present invention, a homolog of a nucleic acid sequence or of an amino acid sequence is preferably at least 5%, 10%, 20%, 30%, 40%, 50%, 60%, more preferably at least 70%, even more preferably at least 80%, even more preferably at least 90%, even more preferably at least 95%, most preferably at least 99%, identical to a reference sequence. It is further preferred that a "homolog" as used herein consists of a continuous stretch of entities, such as nucleotides or amino acid residues, corresponding to a continuous stretch of entities in the reference molecule, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) reference molecule.

Immunogen: In the context of the present invention an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid molecule, preferably an RNA molecule as defined herein. Typically, an immunogen elicits at least an adaptive immune response.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Nucleic acid sequence/amino acid sequence: The sequence of a nucleic acid molecule is typically understood to be the particular and individual order, i.e. the succession of its nucleotides. The sequence of a protein or peptide is typically understood to be the order, i.e. the succession of its amino acid residues.

Peptide: A peptide or polypeptide is typically a polymer of amino acid monomers, linked by peptide bonds. A peptide typically contains less than 50 monomer units. Nevertheless, the term peptide is not a disclaimer for molecules having more than 50 monomer units. Long peptides are also called polypeptides, typically having between 50 and 600 monomeric units. The term 'polypeptide' as used herein, however, is typically not limited by the length of the molecule it refers to. In the context of the present invention, the term 'polypeptide' may also be used with respect to peptides comprising less than 50 (e.g. 10) amino acids or peptides comprising even more than 600 amino acids.

Polyvalent/polyvalent vaccine: A polyvalent vaccine (also referred to as 'multivalent vaccine') typically contains antigens (or fragments or variants thereof) from more than one strain of a virus, or different antigens (or fragments or variants thereof) of the same virus, or any combination thereof. The term "polyvalent vaccine" describes that this vaccine has more than one valence. In the context of the invention, a polyvalent vaccine (e.g. Influenza vaccine, Norovirus vaccine) preferably comprises a vaccine comprising nucleic acids encoding antigenic peptides or proteins derived from several (genetically) different viruses or comprising nucleic acids encoding different antigens from (genetically) the same virus, or a combination thereof. In a preferred embodiment, a polyvalent vaccine comprises 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or even more different RNAs or RNA species, preferably as described herein, each encoding at least one different antigenic peptide or protein. Methods to produce polyvalent mRNA vaccines are disclosed in the PCT application WO20171090134.

Therapeutically effective amount: A therapeutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein: A protein typically comprises one or more peptides or polypeptides. A protein is typically folded into 3-dimensional form, which may be required for the protein to exert its biological function.

RNA, mRNA: RNA is the usual abbreviation for ribonucleic acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. Typically, transcription of DNA usually results in the so-called premature RNA which has to be processed into so-called messenger-RNA, usually abbreviated as mRNA. Processing of the premature RNA, e.g. in eukaryotic organisms, comprises a variety of different post-transcriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, a coding region, a 3'-UTR and a poly(A) sequence. Aside from messenger RNA, several non-coding types of RNA exist which may be involved in regulation of transcription and/or translation.

Sequence identity, identity (of a sequence): Two or more sequences are identical if they exhibit the same length and order of nucleotides or amino acids. The percentage of identity typically describes the extent, to which two sequences are identical, i.e. it typically describes the percentage of nucleotides that correspond in their sequence position with identical nucleotides of a reference sequence. In order to determine the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. Hence, in the context of the present invention, identity of sequences preferably relates to the percentage of nucleotides of a sequence which have the same position in two or more sequences having the same length. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vaccine: A vaccine is typically understood to be a prophylactic or therapeutic material providing at least one antigen, preferably an immunogen. The antigen or immunogen may be derived from any material that is suitable for vaccination. For example, the antigen or immunogen may be derived from a pathogen, such as from bacteria or virus particles etc., or from a tumor or cancerous tissue. The antigen or immunogen stimulates the body's adaptive immune system to provide an adaptive immune response.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising a coding region. Such vectors may be storage vectors, expression vectors, cloning vectors, transfer vectors etc. A storage vector is a vector which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding region and the 3'-UTR and/or the 5'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid which is suitable for storing, transporting, and/or administering a pharmaceutically active compound.

Variant of a sequence: A variant of a nucleic acid sequence or an amino acid sequence typically differs from the original sequence in one or more residues, such as one or more substituted, inserted and/or deleted nucleotides or amino acid residues. Preferably, these variants have the same biological function or specific activity compared to the full-length molecule. In the context of the present invention, a variant of a nucleic acid sequence or of an amino acid sequence is preferably at least 5%, 10%, 20%, 30%, 40%, 50%, 60%, more preferably at least 70%, even more preferably at least 80%, even more preferably at least 90%, even more preferably at least 95%, most preferably at least 99%, identical to a reference sequence. It is further preferred that a "variant" as used herein comprises or consists of a continuous stretch of entities, such as nucleotides or amino acid residues, corresponding to a continuous stretch of entities in the reference molecule, which represents at least 5%, 10%, 20%, 30%, 40%, 50%, 60%, preferably at least 70%, more preferably at least 80%, even more preferably at least 90%, even more preferably at least 95%, most preferably at least 99%, of the total (i.e. full-length) reference molecule.

Method for Modifying the Retention Time of an RNA on a Chromatographic Column:

One aspect of the present invention concerns a method for modifying the retention time of RNA on a chromatographic column. In particular, the invention provides a method for purifying RNA, such as chromatographic purification of RNA from a mixture of RNA species. By modifying the retention time of RNA, the inventive method preferably allows for physical separation of said RNA.

According to preferred embodiments, the invention relates to a method for modifying the retention time of an RNA on a chromatographic column, wherein the method comprises a step of adapting the RNA (sequence) by altering the number of adenine (A) and/or uracil (U) nucleotides in the RNA sequence with respect to the number of A and/or U nucleotides in the original RNA sequence.

The inventors surprisingly found that the total number of A and U nucleotides in an RNA influences the retention time of an RNA on a chromatographic column in a chromatographic process, such as high pressure (high pressure) liquid chromatography (HPLC), more preferably reversed-phase HPLC.

As used herein, the term 'retention time' typically refers to the amount of time a compound, such as RNA, spends on a chromatographic column, after it has been injected. If two compounds in a sample, e.g. two RNA species in an RNA mixture, have different retention times, each compound will spend a different amount of time on the chromatographic column. Retention times are usually quoted in units of seconds or minutes.

In this context, it was also found by the inventors that the separation factor of a given chromatographic method can be modulated by altering the number of adenine (A) and/or uracil (U) nucleotides in an RNA sequence. An increased difference between at least two RNA species in the number of A and/or U nucleotides was found to be correlated with an increased separation factor (cf. FIG. 16). The inventive method may therefore be employed for increasing the separation factor of a chromatographic method by modifying the number of adenine (A) and/or uracil (U) nucleotides in an RNA sequence. A decreased difference between at least two RNA species in the number of A and/or U nucleotides is correlated with a decreased separation factor. The inventive method may therefore be employed for decreasing the separation factor of a chromatographic method by modifying the number of adenine (A) and/or uracil (U) nucleotides in an RNA sequence.

As used herein, the term "RNA species" typically relates to a plurality of RNA molecules or (at least one RNA molecule) having the same nucleotide sequence.

Preferably, the retention time of an RNA species is the time required for said RNA species to migrate, or elute, from the column, measured from the instant the sample is injected into the mobile phase stream to the point at which the peak maximum occurs. Alternatively, the retention time may also be determined by measuring the time from the instant the sample is injected to the appearance of the first unretained RNA at the outlet. In preferred embodiments, the dependence of the retention time on a given flow rate is removed by calculating the corresponding retention volume, which is typically calculated as the retention time multiplied by the volumetric flow rate of the mobile phase. In preferred embodiments, the retention volume may thus be modified by the method according to the invention.

The retention time of RNA is modified by the inventive method, wherein the retention time is preferably increased or decreased. In particular, the retention time of an original RNA (sequence) is modified by altering the number of A and/or U nucleotides in said original RNA (sequence), thereby obtaining an adapted RNA (sequence) having a modified retention time. In this context, the term 'original RNA (sequence)' may refer to any RNA (sequence), which retention time may be modified by the method as described herein. Hence, an 'original RNA (sequence)' may be a wild type RNA sequence. Furthermore, also a modified RNA sequence, preferably an optimized RNA sequence, more preferably as described herein (e.g. an RNA sequence, which has been modified (optimized) with respect to its G/C content), may be used as an 'original RNA (sequence)' in the meaning of the present invention. The term 'adapted RNA (sequence)' as used herein preferably refers to an RNA (sequence), which is derived from the original RNA (sequence), from which it differs by the total number of A and/or U nucleotides. In other words, an adapted RNA (sequence) may be obtained by the inventive method, in particular by altering the number of A and/or U nucleotides in an original RNA (sequence) and thus preferably modifying the RNA's retention time. In a preferred embodiment, an adapted RNA (sequence) is obtained by the inventive method, which differs from the original RNA (sequence) only in the number of A and/or U nucleotides or in the corresponding sequence changes at the respective nucleotide positions.

The retention time of an original RNA is thus typically modified by the inventive method, wherein the retention time of the adapted RNA is preferably modified, more preferably increased or decreased, with respect to the retention time of the original RNA.

As used herein, the term 'RNA (sequence)' may refer to an RNA as an individual compound or to an RNA species, preferably as described herein, or to the nucleotide sequence of a given RNA or RNA species. In the context of the present invention, the term 'RNA species' typically relates to an RNA defined by a certain nucleotide sequence. A plurality of RNA molecules having the same nucleotide sequence may also be referred to herein as 'RNA species'.

In particular, the term 'RNA species' as used herein may refer to a first RNA species, such as a first plurality of RNA molecules sharing the same nucleotide sequence (or to a population of RNA molecules sharing the same nucleotide sequence), wherein said RNA species is preferably present in a mixture with a second (or further) RNA species, such as with a second (or further) plurality of RNA molecules sharing a nucleotide sequence, which is distinct from the nucleotide sequence of the first RNA species (or with a second (or further) population of RNA molecules sharing a nucleotide sequence, which is distinct from the nucleotide sequence of the first RNA species).

The term 'RNA' as used herein may refer to any type of RNA without limitation. Preferably, the term RNA refers to a molecule or to a molecule species selected from the group consisting of long-chain RNA, coding RNA, non-coding RNA, single stranded RNA (ssRNA), double stranded RNA (dsRNA), linear RNA (linRNA), circular RNA (circRNA), messenger RNA (mRNA), RNA oligonucleotides, small interfering RNA (siRNA), small hairpin RNA (shRNA), antisense RNA (asRNA), CRISPR/Cas9 guide RNAs, riboswitches, immunostimulating RNA (isRNA), ribozymes, aptamers, ribosomal RNA (rRNA), transfer RNA (tRNA), viral RNA (vRNA), retroviral RNA or replicon RNA, small nuclear RNA (snRNA), small nucleolar RNA (snoRNA), microRNA (miRNA), circular RNA (circRNA), and a Piwi-interacting RNA (piRNA). Preferably, the RNA is a coding RNA. According to a particularly preferred embodiment, the method is used for modifying the retention time of a coding RNA, preferably an mRNA, more preferably as described herein. According to preferred embodiments, the coding RNA, preferably the mRNA, is a long-chain RNA as described herein.

The method according to the invention is preferably used for modifying the retention time of a single-stranded RNA (ssRNA) or a double-stranded RNA (dsRNA), more preferably of an ssRNA. As used herein, the term 'single-stranded RNA' or 'ssRNA' typically refers to an RNA molecule consisting of a single RNA strand, which may optionally comprise (e.g. based on the conditions), secondary structure elements (e.g. hairpins, stem-loops, etc.). In the context of the present invention, the term 'double-stranded RNA' or 'dsRNA' typically refers to an RNA molecule comprising two RNA strands, which preferably form a (hetero)duplex.

Preferably, RNA as used herein comprises more than 30 nucleotides. More preferably, the RNA is not selected from siRNA, small hairpin RNA, microRNA or small nuclear RNA (snRNA). In a particularly preferred embodiment, the RNA as used herein is not siRNA.

According to a preferred embodiment, the method is used for modifying the retention time of a long-chain RNA. The term 'long-chain RNA' as used herein typically refers to an RNA molecule, preferably as described herein, which preferably comprises at least 30 nucleotides. Alternatively, a long-chain RNA may comprise at least 35, 40, 45, 50, 55, 60, 65, 70, 75, 80, 85, 90, 95, 100, 150, 200, 250, 300, 350, 400, 450, 500, 550, 600, 650, 700, 750 or at least 800 nucleotides. A long-chain RNA molecule may further comprise at least 100 nucleotides, even more preferably at least 200 nucleotides. A long-chain RNA, in the context of the present invention, further preferably comprises from 30 to 50.000 nucleotides, from 30 to 20000 nucleotides, from 100 to 20000 nucleotides, from 200 to 20000 nucleotides, from 200 to 15000 nucleotides, from 500 to 20000 nucleotides, from 800 to 20000 nucleotides, from 800 to 5000 nucleotides or from 800 to 2000 nucleotides. The term 'long-chain RNA' as used herein is not limited to a certain type of RNA, but merely refers to the number of nucleotides comprised in said RNA. For example, the long-chain RNA may be a coding RNA, preferably an mRNA, more preferably as described herein.

According to preferred embodiments of the invention, the number of A and/or U nucleotides in the original RNA sequence is determined. In the context of the present invention, the phrase 'number of A and/or U nucleotides' may refer to the total number of adenine (A) nucleotides, to the total number of uracil (U) nucleotides or, more preferably, to the total number of A and U nucleotides. The number of A and/or U nucleotides is preferably increased or decreased to a target number, which may be a known number or a number, which has been pre-determined, preferably as described herein. That target number is preferably selected according to the respective purpose. The modification of the retention time is typically the greater the larger the difference is between the target number and the original number of A and/or U nucleotides in the original RNA sequence.

Accordingly, the inventive method comprises a step of determining the number of A and/or U nucleotides in the original RNA sequence and a step of increasing or decreasing said number of A and/or U nucleotides in order to obtain the adapted RNA sequence.

As used herein, the term 'adenine nucleotide' or 'A nucleotide' typically refers to an adenine nucleotide or to an analogue thereof, such as a chemically modified A nucleotide, preferably as described herein. The term 'uracil nucleotide' or 'U nucleotide' may refer to an uracil nucleotide or to an analogue thereof, such as a chemically modified U nucleotide, preferably as described herein. In this context, the phrase 'number of A and/or U nucleotides' may also refer to the total number of adenine (A) nucleotides and adenine nucleotide analogues, to the total number of uracil (U) nucleotides and uracil nucleotide analogues, or, more preferably, to the total number of A nucleotides, adenine nucleotide analogues, U nucleotides and U nucleotide analogues. In a similar manner, the terms 'guanine nucleotide' or 'G nucleotide' may refer to a guanine nucleotide or to an analogue thereof, such as a chemically modified G nucleotide, preferably as described herein. The term 'cytosine nucleotide' or 'C nucleotide' may refer to a cytosine nucleotide or to an analogue thereof, such as a chemically modified C nucleotide, preferably as described herein.

Wherever reference is made herein to an A, U, G, or C nucleotide, the respective nucleotide analogues, preferably as described herein, more preferably a chemically modified nucleotide, is also comprised by that term.

Where reference is made herein to an 'uracil nucleotide', an 'U nucleotide' or an analogue of an uracil nucleotide, it is further understood that these terms may also relate to a thymine nucleotide in the DNA sequence corresponding to an RNA sequence (e.g. in a DNA vector encoding an RNA as described herein).

The length of the original RNA is preferably not modified so that the total number of nucleotides in the original RNA and the adapted RNA is essentially the same. Alternatively, the length of the original RNA may also be increased or decreased, e.g. by addition or deletion of nucleotides.

In preferred embodiments, G and/or C nucleotides in the original RNA sequence are replaced with A and/or U nucleotides thereby altering, particularly increasing the number of A and/or U nucleotides in the RNA sequence with respect to the number of A and/or U nucleotides in the original RNA sequence.

According to some embodiments, the inventive method comprises a step of replacing G and/or C nucleotides in the original RNA sequence with A and/or U nucleotides.

Alternatively, A and/or U nucleotides in the original RNA sequence may be replaced with G and/or C nucleotides thereby altering, particularly decreasing the number of A and/or U nucleotides in the RNA sequence with respect to the number of A and/or U nucleotides in the original RNA sequence.

According to some embodiments, the inventive method comprises a step of replacing A and/or U nucleotides in the original RNA sequence with G and/or C nucleotides.

According to some embodiments, the method may also comprise a step of introducing additional nucleotides, preferably G and/or C nucleotides, more preferably A and/or U nucleotides, into an RNA sequence. Therein, nucleotides are preferably inserted into a non-coding region of the original RNA sequence.

In preferred embodiments, the invention concerns a method for modifying the retention time of an RNA comprising at least one coding region. In these embodiments, the number of A and/or U nucleotides is preferably altered within a coding region, preferably as described herein. For example, G and/or C nucleotides in a coding region are replaced with A and/or U nucleotides in order to increase the number of A and/or U nucleotides in the coding region. Alternatively, A and/or U nucleotides in a coding region may be replaced with G and/or C nucleotides in order to decrease the number of A and/or U nucleotides in the coding region.

In a particularly preferred embodiment, the number of A and/or U nucleotides in at least one coding region in an RNA is altered without modifying the amino acid sequence encoded by the coding sequence of the original RNA (sequence). The degeneracy of the genetic code allows for exchanges of codons in the coding region, which do not alter the encoded amino acid sequence. The method according to the invention thus preferably comprises exchanging at least one codon in a coding region of the RNA with an alternative codon encoding the same amino acid, wherein the alternative codon is preferably characterized by a number of A and/or U nucleotides that is different from the number of A and/or U numbers in the original codon. Reference is made to the description herein of the inventive method for providing an adapted RNA sequence, where the selection of suitable codon exchanges is explained in more detail.

The number of A and/or U nucleotides is preferably increased or decreased to such an extent that the retention time is sufficiently modified for a given purpose. Depending on the purpose, the number of A and/or U nucleotides may be adapted to a pre-determined target number. For example, the number of A and/or U nucleotides in a given (original) RNA sequence may be adapted to the number or essentially the same number of A and/or U nucleotides in the sequence of another RNA species, which is also present in a mixture and which is to be co-purified with the RNA to be adapted. RNA species having essentially the same number of A and/or U nucleotides are typically characterized by essentially the same retention time on a chromatographic column, such as an HPLC column. According these RNA species elute from the column in the same fraction (peak). Alternatively, the target number may be selected such that the difference from the number of A and/or U nucleotides in another RNA species in a mixture is sufficient for the adapted RNA to elute in a separate fraction (peak) (which allows for determining the integrity of each RNA species).

In preferred embodiments, the number of A and/or U nucleotides in an RNA sequence is altered so that the number of A and/or U nucleotides in the adapted RNA sequence differs by at least 1, preferably by at least 2, more preferably by at least 3, even more preferably by at least 4, even more preferably by at least 5, even more preferably by at least 10, most preferably by at least 15, from the number of A and/or U nucleotides in the original RNA sequence. Alternatively, the number of A and/or U nucleotides in the adapted RNA sequence may differ by at least 5, preferably by at least 10, more preferably by at least 20, even more preferably by at least 30, even more preferably by at least 40, even more preferably by at least 50, most preferably by at least 60, from the number of A and/or U nucleotides in the original RNA sequence. Alternatively, the number of A and/or U nucleotides in the adapted RNA sequence may differ by at least 60, preferably by at least 80, more preferably by at least 100, even more preferably by at least 120, even more preferably by at least 140, even more preferably by at least 160, most preferably by at least 200, from the number of A and/or U nucleotides in the original RNA sequence.

According to preferred embodiments, the method is used for increasing the retention time of the adapted RNA with respect to the retention time of the original RNA, wherein the number of A and/or U nucleotides in the adapted RNA sequence is increased by at least 1, preferably by at least 2, more preferably by at least 3, even more preferably by at least 4, even more preferably by at least 5, even more preferably by at least 10, most preferably by at least 15, with respect to the number of A and/or U nucleotides in the original RNA sequence. Alternatively, the number of A and/or U nucleotides in the adapted RNA sequence may be increased by at least 5, preferably by at least 10, more preferably by at least 20, even more preferably by at least 30, even more preferably by at least 40, even more preferably by at least 50, most preferably by at least 60, with respect to the number of A and/or U nucleotides in the original RNA sequence. Alternatively, the number of A and/or U nucleotides in the adapted RNA sequence may be increased by at least 60, preferably by at least 80, more preferably by at least 100, even more preferably by at least 120, even more preferably by at least 140, even more preferably by at least 160, most preferably by at least 200, with respect to the number of A and/or U nucleotides in the original RNA sequence.

The method may also be used for decreasing the retention time of the adapted RNA with respect to the retention time of the original RNA, wherein the number of A and/or U nucleotides in the adapted RNA sequence is decreased by at least 1, preferably by at least 2, more preferably by at least 3, even more preferably by at least 4, even more preferably by at least 5, even more preferably by at least 10, most preferably by at least 15, with respect to the number of A and/or U nucleotides in the original RNA sequence. Alternatively, the number of A and/or U nucleotides in the adapted RNA sequence may be decreased by at least 5, preferably by at least 10, more preferably by at least 20, even more preferably by at least 30, even more preferably by at least 40, even more preferably by at least 50, most preferably by at least 60, with respect to the number of A and/or U nucleotides in the original RNA sequence. Alternatively, the number of A and/or U nucleotides in the adapted RNA sequence may be decreased by at least 60, preferably by at least 80, more preferably by at least 100, even more preferably by at least 120, even more preferably by at least 140, even more preferably by at least 160, most preferably by at least 200, with respect to the number of A and/or U nucleotides in the original RNA sequence.

In some embodiments, the method comprises a step of adapting the original RNA sequence by altering the number of A and/or U nucleotides in such a manner that the ratio of the number of A nucleotides to the number of U nucleotides is from 0.2 to 5, preferably from 0.5 to 3, more preferably from 1 to 3, even more preferably from 1 to 2.5, even more preferably from 1.2 to 2, even more preferably from 1.4 to 2, even more preferably from 1.5 to 2, most preferably from 1.6 to 2.

According to some embodiments, the retention time of RNA on a chromatographic column is modified, wherein altering the number of A nucleotides in the RNA sequence has a stronger impact on the retention time of the RNA than altering the number of U nucleotides of the RNA sequence. Preferably, the change in retention time achieved by altering the number of A nucleotides is about 1.2, 1.3, 1.4, 1.5, 1.6, 1.7, 1.8, 1.9 or 2 times, preferably 1.5 times, stronger than the change in retention time achieved by altering the same number of U nucleotides.

In some embodiments, the ratio of the number of A nucleotides to the number of U nucleotides in the RNA sequence is increased (without changing the total number of A and U nucleotides) with respect to the ratio of the number of A nucleotides to the number of U nucleotides in the original RNA sequence, thereby increasing the retention time of the adapted RNA.

Alternatively, the ratio of the number of A nucleotides to the number of U nucleotides in the RNA sequence is decreased (without changing the total number of A and U nucleotides) with respect to the ratio of the number of A nucleotides to the number of U nucleotides in the original RNA sequence, thereby decreasing the retention time of the adapted RNA.

Each embodiment of the inventive method, which comprises a step of altering the number of A and/or U nucleotides in the RNA sequence in any manner that leads to a desired modification of the retention time (decrease or increase) may be used as individual step or in any combination thereof.

Accordingly, as defined herein, an increase of the retention time of the RNA may preferably be obtained by replacing G and/or C nucleotides in the original RNA sequence, preferably in the coding region, with A and/or U nucleotides and/or by introducing additional A and/or U nucleotides into the original RNA sequence, preferably into an UTR region, and/or by increasing the ratio of the number of A nucleotides to the number of U nucleotides (without changing the total number of A and U nucleotides) in the RNA sequence with respect to the ratio of the number of A nucleotides to the number of U nucleotides in the original RNA sequence, wherein all of these adaptations are suitably applied without modifying the amino acid sequence encoded by the coding region of the original RNA (sequence).

Accordingly, as defined herein, a decrease of the retention time of the RNA may be obtained by replacing A and/or U nucleotides in the original RNA sequence, preferably in the coding region, with G and/or C nucleotides and/or by introducing additional G and/or C nucleotides into the original RNA sequence, preferably into an UTR region, and/or by decreasing the ratio of the number of A nucleotides to the number of U nucleotides (without changing the total number of A and U nucleotides) in the RNA sequence with respect to the ratio of the number of A nucleotides to the number of U nucleotides in the original RNA sequence, wherein all of these adaptations are suitably applied without modifying the amino acid sequence encoded by the coding region of the original RNA (sequence).

In preferred embodiments, the method comprises a step of adapting the original RNA sequence by altering the number of A and/or U nucleotides in the RNA sequence as described herein with respect to a method for purifying at least one RNA species from a mixture and/or as described herein with respect to a method for co-purifying at least two RNA species from a mixture.

The method according to the invention is preferably provided as a method for modifying the retention time of RNA on a chromatographic column, wherein the chromatographic column is an HPLC column. In this context, the method is preferably used for modifying the retention time of RNA under conditions suitable for analytical or preparative purification of RNA. Chromatographic procedures and experimental conditions suitable for purifying RNA on an analytical or on a preparative scale, in particular by RP- HPLC, are known in the art and were described, for example, in WO 2008/077592, which is hereby incorporated by reference in its entirety.

In preferred embodiments, the method is used for modifying the retention time of RNA on a chromatographic column in a reversed-phase HPLC (RP-HPLC). Preferably, the RP-HPLC is as described in WO 2008/077592. According to a preferred embodiment, the chromatographic column comprises a reversed phase as a stationary phase. In reversed-phase chromatography, a nonpolar compound is preferably used as the stationary phase and a polar solvent, such as an aqueous solution of e.g. acetonitrile and/or methanol, is used as the mobile phase for elution.

The column, which is used as stationary phase, may be provided in bead form or as a monolithic column, which is preferably a polymerized 'block', i.e. a block which fills a substantial part of the chromatography column. Irrespective of its precise nature, the polymeric stationary phase, in particular if used for preparative purification, is preferably porous in its nature, which means that the beads or the block are characterized by pores. In other embodiments, the reversed phase is a non-porous reversed phase.

In a preferred embodiment, in particular if used for preparative purification, a porous reversed phase material is provided with a particle size of 8.0 µm to 50 µm, in particular 8.0 to 30, still more preferably 8.0 to 25 µm. The reversed phase material may be present in the form of small beads. The method according to the invention may be performed particularly favourably with a porous reversed phase with this particle size, optionally in bead form, wherein particularly good separation results are obtained for preparative purification.

In a preferred embodiment, the reversed phase has a pore size of 1000 Å to 5000 Å, in particular a pore size of 1000 Å to 4000 Å, more preferably 1500 Å to 4000 Å, 2000 Å to 4000 Å or 2500 Å to 4000 Å. Particularly preferred pore sizes for the reversed phases are 1000 Å to 2000 Å, more preferably 1000 Å to 1500 Å and most preferably 1000 Å to 1200 Å or 3500-4500 Å. In other embodiments, the reversed phase is a porous reversed phase with undefined pore size.

A pore size of 1000 Å to 5000 Å, in particular a pore size of 1000 Å to 4000 Å, more preferably 1500 Å to 4000 Å, 2000 Å to 4000 Å or 2500 Å to 4000 Å may be suitable to separate an RNA from other components of a mixture, the RNA preferably having a size as mentioned herein with respect to the long-chain RNA, e.g. of up to about 15000 nucleotides (as single stranded RNA molecule) or base pairs (as double stranded RNA molecule), in particular 100 to 10000, more preferably 500 to 10000 nucleotides or base pairs, even more preferably 800 to 5000 nucleotides or base pairs and even more preferably 800 to 2000 nucleotides or base pairs. However, the pore size of the reversed phase may also be selected in dependence of the size of the RNA to be separated, i.e. a larger pore size may be selected, if larger RNA molecules are to be separated and smaller pore sizes may be selected, if smaller RNA molecules may be selected. This is due to the effect, that the retention of the RNA molecules and the separation not only depends on the interaction of the (reversed) phase but also on the possibility of molecules to get inside the pores of the matrix and thus provide a further retention effect. Without being limited thereto, e.g. a pore size for the reversed phase of about 2000 Å to about 5000 Å, more preferably of about 2500 to about 4000, most preferably of about 3500 to about 4500 Å, may thus be used to separate larger RNA molecules, e.g. RNA molecules of 100 to 10000, more preferably 500 to 10000 nucleotides or base pairs, even more preferably 800 to 5000 nucleotides or base pairs and even more preferably 800 to 2000 nucleotides or base pairs. Alternatively, without being limited thereto, a pore size of for the reversed phases of about 1000 Å to about 2500 Å, more preferably of about 1000 Å to about 2000 Å, and most preferably of about 1000 Å to 1200 Å may be used to separate smaller RNA molecules, e.g. RNA molecules of about 30-1000, 50-1000 or 100-1000 or 20-200, 20-100, 20-50 or 20-30 nucleotides may also be separated in this way.

In general, any material known to be used as reverse phase stationary phase, in particular any polymeric material may be used for chromatographic method in the context of the present invention. The stationary phase may be composed of organic and/or inorganic material. Examples for polymers to be used for the present invention are (non-alkylated or alkylated) polystyrenes, (non-alkylated or alkylated) polystyrenedivinylbenzenes, silica gel, silica gel modified with non-polar residues, particularly silica gel modified with alkyl containing residues, more preferably with butyl-, octyl and/or octadecyl containing residues, silica gel modified with phenylic residues, polymethacrylates, etc. or other materials suitable e.g. for gel chromatography or other chromatographic methods as mentioned above, such as dextran, including e.g. Sephadex® and Sephacryl® materials, agarose, dextran/agarose mixtures, polyacrylamide, etc.

Preferably, the chromatographic column comprises a material selected from the group consisting of polystyrene, a non-alkylated polystyrene, an alkylated polystyrene, a polystyrenedivinylbenzene, a non-alkylated polystyrenedivinylbenzene, an alkylated polystyrenedivinylbenzene, a silica gel, a silica gel modified with non-polar residues, a silica gel modified with alkyl containing residues, selected from butyl-, octyl and/or octadecyl containing residues, a silica gel modified with phenylic residues, or a polymethacrylate.

In a particularly preferred embodiment, the chromatographic column comprises a material selected from the group consisting of a polystyrene polymer, a non-alkylated polystyrene polymer, an alkylated polystyrene polymer, a non-alkylated polystyrenedivinylbenzene polymer, an alkylated polystyrenedivinylbenzene, a silica gel, a silica gel modified with non-polar residues, particularly silica gel modified with alkyl containing residues, more preferably with butyl-, octyl and/or octadecyl containing residues, porous silica gel modified with phenylic residues, polymethacrylates. All these materials may be porous, preferably as described herein, or non-porous.

Stationary phases with polystyrenedivinylbenzene are known per se. The per se known polystyrenedivinyl-benzenes already used for HPLC methods, which are commercially obtainable, may be used for the chromatographic method in the context of the invention.

In preferred embodiments, a non-alkylated porous polystyrenedivinylbenzene is particularly preferred, which, without being limited thereto, may have in particular a particle size of 8.0±1.5 µm, in particular 8.0±0.5 µm, and a pore size of 1000-1500 Å, in particular 1000-1200 Å or 3500-4500 Å.

In further embodiments, an alkylated, macro porous monolithic polystyrenedivinylbenzene is particularly preferred, which, without being limited thereto, may have a pore size distribution of about 0.1 um-10 µm, particularly about of 1 um-10 µm, more particularly of about 1 um-6 µm.

In further embodiments a porous silica gel is used. The porous silica gel may be prepared from tetraethoxysilane and bis(triethoxysilyl)ethane used in a 4:1 molar ratio and the porous silica gel is modified with an octadecyl carbon chain. Such porous silica gel is commercially available, e.g. XBRIDGE™ OST C18 from Waters or AQUITY UPLC OST C18 from Waters.

The silica gel may have a particle size of 0.5 to 5 μm, preferably of 0.7 to 4 μm, more preferably of 1 to 3 μm, even more preferably of 1.5 to 2 μm and most preferably of 1.7 μm. The pore size of the porous silica gel may be 50 to 300 Å, preferably 70 to 250 Å, more preferably 100 to 200 Å, even more preferably 120 to 170 Å and most preferably it is 135 Å.

In a preferred embodiment, a mixture of an aqueous solvent and an organic solvent is used in HPLC as the mobile phase for eluting the RNA. It is favourable for a buffer to be used as the aqueous solvent which has in particular a pH of 6.0-8.0, for example of about 7, for example 7.0. Preferably the buffer is triethylammonium acetate, more preferably a 0.02 M to 0.5 M, in particular 0.08 M to 0.12 M, even more preferably an about 0.1 M triethylammonium acetate buffer. In a preferred embodiment, the organic solvent which is used in the mobile phase is acetonitrile, methanol, ethanol, 1-propanol, 2-propanol and acetone or a mixture thereof, very particularly preferably acetonitrile. In a particularly preferred embodiment, the mobile phase is a mixture of 0.1 M triethylammonium acetate, pH 7, and acetonitrile.

Any one of the individual steps or features (or a combination of such steps or features) described herein with respect to the method for modifying the retention time of an RNA may also be applied with respect to any one of the other aspects of the present invention as described herein, in particular to the method for purifying at least one RNA species from a mixture of at least two RNA species, the method for co-purifying at least two RNA species from a mixture of at least two RNA species, the method for harmonizing the numbers of A and/or U nucleotides in the sequences of at least two RNA species, or the method for providing an adapted RNA as described herein.

Method for Purifying at Least One RNA Species from a Mixture:

In a further aspect, the present invention concerns a method for purifying at least one RNA species from a mixture of at least two RNA species. This method is preferably characterized by any one of the method steps or any one of the features (or a combination thereof) described herein with regard to other aspects of the invention, in particular with regard to the method for modifying the retention time of an RNA or the method for co-purifying at least two RNA species from a mixture comprising at least two RNA species.

In preferred embodiments, the method for purifying at least one RNA species from a mixture of at least two RNA species comprises:
a) a step of adapting the sequence of the at least one RNA species by altering the number of A and/or U nucleotides with respect to the number of A and/or U nucleotides in the original sequence; and
b) a chromatographic step, wherein the adapted RNA species is separated from at least one other RNA species.

In the context of the present invention, the term 'purifying' is understood to mean that a desired RNA (species) in a sample is separated and/or isolated from another compound, which is further present in a mixture, typically a solution. These other compounds may be, for example, impurities or other RNA species, from which the desired RNA (species) is to be separated. Thus, after HPLC purification the RNA is present in a purer form than in the originally introduced RNA-containing sample prior to HPLC purification. Undesired constituents of RNA-containing samples which therefore need to be separated may in particular be impurities derived from an in vitro transcription reaction, such as degraded RNA fragments or fragments, which have arisen as a result of premature termination of transcription, or also excessively long transcripts if plasmids are not completely linearized. In addition, impurities such as enzymes, for example RNases and polymerases, and nucleotides may be separated.

Using the methods according to the invention, RNA is purified which has a higher purity after purification than the starting material. It is desirable in this respect for the degree of purity to be as close as possible to 100%. A degree of purity of more than 70%, in particular 80%, very particularly 90% and most favourably 99% or more may be achieved in this way.

According to a preferred embodiment, the method for purifying at least one RNA species from a mixture of at least two RNA species comprises in step b) an HPLC process, preferably an RP-HPLC process, as described herein and, in further detail, in WO 2008/077592.

According to preferred embodiments, the method for purifying at least one RNA species from a mixture of at least two RNA species is used as an analytical purification process, e.g. during quality control in RNA manufacture. Preferably, the method is used for determining the identity and/or integrity of at least one RNA species. For example, the sequence of one RNA, which may have the same or essentially the same retention time as another RNA species in the mixture and thus elutes in one fraction (peak) together with that other RNA species, may be adapted in order for the adapted RNA species to have a distinct retention time, which results in separation of the fractions (peaks), into which the respective RNA species elute (see also FIG. 1E).

According to a preferred embodiment, the method for purifying at least one RNA species from a mixture of at least two RNA species further comprises a step of determining the identity and/or integrity of at least one RNA species.

The term "integrity" describes whether complete RNA molecules are present in a sample applied to the analytical purification process as described herein. If complete RNA molecules are present, the RNA molecule of the at least one RNA species in a mixture of at least two RNA species will have the expected length. If incomplete RNA molecules are present, the length of the RNA molecule will be different from the expected or known length. Low integrity or differences in the length of the RNA molecules could be due to, amongst others, degradation, cleavage, incorrect base pairing, lack of or incomplete capping, lack of or incomplete polyadenylation, or incomplete transcription. This will become evident in a broadening of the HPLC peak of the RNA during the analytical purification process as described herein.

In an analytical purification process, smaller amounts of RNA are typically subjected to an HPLC. A typical amount of RNA subjected to analytical purification process may be smaller than about 5 μg, e.g. about 4 μg or less, about 3 μg or less, about 2 μg or less, about 1 μg or less, about 500 ng or less, about 400 ng or less, about 300 ng or less, about 200 ng or less, about 100 ng or less, or about 50 ng or less. Preferably, the amount of RNA subjected to an analytical purification process is in a range selected from about 1 ng to about 5 μg, from about 10 ng to about 4 μg, from about 10 ng to about 3 μg, from about 10 ng to about 2 μg, from about 10 ng to about 1 μg, or from about 50 ng to 5 μg. More preferably, the amount of RNA subjected to an analytical purification process is at least about 10 ng.

The method for purifying at least one RNA species from a mixture of at least two RNA species may also be used on a preparative scale. In particular, the method according to the invention may be employed in order to purify an adapted RNA sequence from a mixture, which has been pre-purified in at least one other purification step (e.g. by HPLC).

In a preparative purification process, larger amounts of RNA are typically subjected to an HPLC. A typical amount of RNA subjected to a preparative purification process may be larger than 5 µg, e.g. about 10 µg or more, about 100 µg or more, about 1 mg or more, about 10 mg or more, about 100 mg or more, about 1 g or more, about 10 g or more, about 100 g or more, about 1 kg or more, about 10 kg or more. Preferably, the amount of RNA subjected to a preparative purification process is in a range selected from about 5 µg to about 10 kg, from about 5 µg to about 1 kg, from about 5 µg to about 500 g, from about 5 µg to about 100 g, from about 5 µg to about 50 g, or from about 5 µg to about 10 g.

Preferably, step a) of the method comprises a step of modifying the retention time of at least one RNA species from a mixture of at least two RNA species on a chromatographic column as described herein.

In certain embodiments, the retention time of the at least one RNA species to be purified (in its unmodified/non-adapted state, corresponding to the original RNA (sequence)) is essentially the same as the retention time of the RNA species, from which it is to be separated or the retention times are so close that the RNA species elute from a chromatographic column in the same fraction (peak) or in overlapping fractions (peaks) that do not allow for physical separation of the RNA species, and in addition, do not allow for determining the integrity of at least one RNA species.

In preferred embodiments, the number of A and/or U nucleotides in the sequence of the at least one RNA species to be purified is altered as described herein so that physical separation of the at least one RNA species from other components in a mixture is feasible by chromatography, preferably by HPLC, more preferably by RP-HPLC. The retention time of the at least one RNA species is preferably modified such that the RNA species elutes in a separate fraction (peak), which does not comprise at least one other compound (e.g. another RNA species or impurities such as abortive sequences etc.), from which the at least one RNA species is to be separated. The modified retention time of the at least one adapted RNA species is different from the retention time of at least one further RNA species in the mixture, from which it may preferably be physically separated, more preferably by HPLC.

According to a particularly preferred embodiment, step a) of the method comprises adapting the sequence of the at least one RNA species to be purified so that the number of A and/or U nucleotides in the adapted sequence of the at least one RNA species differs by at least 1, preferably by at least 2, more preferably by at least 3, even more preferably by at least 4, even more preferably by at least 5, even more preferably by at least 10, most preferably by at least 15, from the number of A and/or U nucleotides in the sequence of at least one other RNA species, which is present in the mixture and from which the adapted RNA species is to be separated. Alternatively, the number of A and/or U nucleotides in the adapted sequence of the at least one RNA species may differ by at least 5, preferably by at least 10, more preferably by at least 20, even more preferably by at least 30, even more preferably by at least 40, even more preferably by at least 50, most preferably by at least 60, from the number of A and/or U nucleotides in the sequence of another RNA species in the mixture.

In preferred embodiments, e.g. an analytical purification process, step a) of the method comprises adapting the sequence of the at least one RNA species to be purified so that the number of A and/or U nucleotides in the adapted sequence of the at least one RNA species may differ by at least 10, preferably by at least 20, more preferably by at least 30, even more preferably by at least 40, even more preferably by at least 50, even more preferably by at least 60, most preferably by at least 70, from the number of A and/or U nucleotides in the sequence of another RNA species in the mixture.

In preferred embodiments, e.g. a preparative purification process, step a) of the method comprises adapting the sequence of the at least one RNA species to be purified so that the number of A and/or U nucleotides in the adapted sequence of the at least one RNA species may differ by at least 80, preferably by at least 100, more preferably by at least 120, even more preferably by at least 140, even more preferably by at least 180, even more preferably by at least 200, most preferably by at least 220, from the number of A and/or U nucleotides in the sequence of another RNA species in the mixture.

According to preferred embodiments, e.g. in an analytical purification process, the sequence of the at least one RNA species to be purified is adapted so that the number of A and/or U nucleotides in the adapted RNA differs from the respective number in the sequence of at least one other RNA species in the mixture, from which it is to be separated by a number, which is equal to or greater than the total number of nucleotides in the sequence of the at least one RNA to be purified multiplied by a factor of at least 0.05, at least 0.06, at least 0.07, at least 0.08, at least 0.09, at least 0.1 or at least 0.15. In a preferred embodiment, the number of A and/or U nucleotides in the adapted RNA differs from the respective number in the sequence of the at least one other RNA species in the mixture, from which it is to be separated by a number, which is equal to or greater than the total number of nucleotides in the sequence of the at least one RNA to be purified multiplied by a factor of 0.065. In these embodiments, the at least one RNA species to be purified preferably has the same length (i.e. comprises the same total amount of nucleotides) as the RNA species, from which it is to be separated. More preferably, the lengths of the RNA species differ by not more than about 20%, not more than about 10%, not more than about 5%, not more than about 4%, not more than about 3%, not more than about 2%, or not more than about 1%.

According to preferred embodiments, e.g. in an analytical purification process, the sequence of the at least one RNA species to be purified is adapted so that the number of A and/or U nucleotides in the adapted RNA differs from the respective number in the sequence of at least one other RNA species in the mixture, from which it is to be separated by a number, which is equal to or greater than the total number of nucleotides in the sequence of the at least one RNA to be purified multiplied by a factor of at least 0.01, at least 0.02, at least 0.03, at least 0.04, or at least 0.05. In these embodiments, the at least one RNA species to be purified preferably has the same length (i.e. comprises the same total amount of nucleotides) as the RNA species, from which it is to be separated. More preferably, the lengths of the RNA species differ by not more than about 20%, not more than about 10%, not more than about 5%, not more than about 4%, not more than about 3%, not more than about 2%, or not more than about 1%.

According to preferred embodiments, e.g. in a preparative purification, the sequence of the at least one RNA species to be purified is adapted so that the number of A and/or U nucleotides in the adapted RNA differs from the respective number in the sequence of at least one other RNA species in the mixture, from which it is to be separated by a number, which is equal to or greater than the total number of nucleotides in the sequence of the at least one RNA to be purified multiplied by a factor of at least 0.20, at least 0.22, at least 0.24, at least 0.26, at least 0.28, at least 0.30 or at least 0.35. In these embodiments, the at least one RNA species to be purified preferably has the same length (i.e. comprises the same total amount of nucleotides) as the RNA species, from which it is to be separated. More preferably, the lengths of the RNA species differ by not more than about 20%, not more than about 10%, not more than about 5%, not more than about 4%, not more than about 3%, not more than about 2%, or not more than about 1%.

Method for Co-Purifying at Least Two RNA Species from a Mixture:

According to a further aspect, the present invention provides a method for co-purifying at least two RNA species from a mixture comprising at least two RNA species, wherein the method comprises:
a) a step of adapting the sequence of at least one RNA species by altering the number of A and/or U nucleotides in the RNA with respect to the number of A and/or U nucleotides in the original RNA sequence; and
b) a chromatographic step, wherein the at least one RNA species having an adapted sequence and at least one further RNA species are co-purified.

This method preferably comprises any one of the method steps or any one of the features (or a combination thereof) described herein with regard to other aspects of the invention, in particular with regard to the method for modifying the retention time of an RNA or with regard to the method for purifying at least one RNA species from a mixture of at least two RNA species.

The method is preferably used for co-purifying at least two RNA species from a mixture comprising at least two RNA species, wherein the at least two RNA species (in their unmodified/non-adapted state) are characterized by distinct retention times, which result in elution of the at least two RNA species in separate fractions (peaks), which do not allow for co-purification.

In the method for co-purifying at least two RNA species from a mixture comprising at least two RNA species, the number of A and/or U nucleotides in an original RNA sequence is preferably altered in such a manner that the retention time of the RNA is essentially identical to or at least sufficiently close to the retention time of another compound (such as another RNA species), which is further present in a mixture together with the adapted RNA, for the adapted RNA and the other compound (e.g. another RNA species) to be co-purified by a chromatographic procedure, preferably by HPLC, more preferably by RP-HPLC as described herein. The adapted RNA and the other compound (e.g. another RNA species) preferably elute from the chromatographic column together in one fraction (or appear in the chromatogram as one single peak, respectively). The adaptation of the number of A and/or U nucleotides in an RNA (sequence) in order to obtain an adapted RNA having essentially the same retention time as another RNA species may also be referred to herein as '(peak) harmonization' or 'harmonization of the retention times'.

More preferably, the number of A and/or U nucleotides in an original RNA sequence is preferably altered in such a manner that the retention time of the RNA (species) differs by not more than about 20%, preferably not more than about 10%, not more than about 5%, not more than about 4%, not more than about 3%, not more than about 2%, not more than about 1%, not more than 0.5% or not more than 0.1%, from the retention time of another compound (such as another RNA species), which is further present in a mixture together with the adapted RNA.

In a further aspect, the present invention thus also provides a method for harmonizing the numbers of A and/or U nucleotides in the sequences at least two RNA species, the method comprising adapting the sequence of at least one RNA species by altering the number of A and/or U nucleotides in the RNA sequence with respect to the number of A and/or U nucleotides in the original RNA sequence. Said method preferably applies any one of the steps or any one of the features (or a combination thereof) described herein with respect to the method for co-purifying at least two RNA species.

Hence, the retention times of harmonized RNA species as used herein preferably differ by not more than about 20%, more preferably by not more than about 10%, by not more than about 5%, by not more than about 4%, by not more than about 3%, by not more than about 2%, by not more than about 1%, by not more than 0.5% or by not more than 0.1%. Even more preferably, harmonized RNA species are characterized by essentially identical retention times.

In a further aspect, the present invention provides a method for synthesis of a mixture comprising at least two harmonized RNA species, preferably as described herein, the method comprising
a) a step comprising harmonizing the numbers of A and/or U nucleotides in the sequences of at least two RNA species, wherein the sequence of at least one RNA species is adapted by altering the number of A and/or U nucleotides in the RNA sequence with respect to the number of A and/or U nucleotides in the original RNA sequence; and
b) a step of synthesis of the at least two harmonized RNA species.

Step a) of this method preferably comprises adaptation of the RNA sequence of at least one of the RNA sequences by altering the number of A and/or U nucleotides in the RNA sequence with respect to the number of A and/or U nucleotides in the original RNA. In this respect and also with regard to step b), reference is made to the description of the inventive method for modifying the retention time of RNA on a chromatographic column, the inventive method for purifying at least one RNA from a mixture of at least two RNA species or the inventive method for co-purifying at least two RNA species from a mixture comprising at least two RNA species. Any one of the features described herein with respect to one or more of said methods preferably also apply to the inventive method for synthesis of a mixture comprising at least two harmonized RNA species.

In some embodiments, step a) of the method for synthesis of a mixture comprising at least two harmonized RNA species may comprise:
i) optionally, determining the total number of nucleotides in an original RNA sequence;
ii) determining the number of A and/or U nucleotides in the original RNA sequence;

iii) determining the codons in the original RNA sequence that can be replaced with at least one alternative codon without changing the encoded amino acid sequence;

iv) adjusting the number of A and/or U nucleotides in the RNA sequence to a pre-set number of A and/or U nucleotides by replacing at least one original codon with an alternative codon, wherein the alternative codon encodes the same amino acid as the original codon and is further characterized in a higher content of A and/or U nucleotides.

Step b) of the method for synthesis of a mixture comprising at least two harmonized RNA species preferably comprises the separate synthesis of the at least two harmonized RNA species. In order to obtain a mixture of harmonized RNA species, at least two harmonized RNA species are preferably mixed together. Alternatively, step b) comprises synthesis of the at least two harmonized RNA species in one batch. The at least two harmonized RNA species may be synthesized by any method known in the art, e.g. by chemical synthesis. Preferably, the harmonized RNA species are synthesized by RNA in vitro transcription.

The term "mixture" as used in this context preferably refers to a solid, semi-solid or liquid mixture. Preferably, the mixture comprising at least two harmonized RNA species may be a liquid, more preferably an aqueous solution. Further suitable solvents, buffers and excipients are known in the art and are also further described herein, in particular with respect to the inventive composition. In preferred embodiments, the mixture comprising at least two harmonized RNA species, which is obtained by the inventive method for synthesis of a mixture comprising at least two harmonized RNA species, is a composition that is preferably characterized by any one of the features described with respect to the composition (comprising at least two RNA species) as described herein.

According to a preferred embodiment, the method for co-purifying at least two RNA species (or the method for harmonizing the number of A and/or U nucleotides in the sequences of at least two RNA species or the method for synthesis of a mixture comprising at least two harmonized RNA species) comprises a step of determining a target number of A and/or U nucleotides, to which the number of A and/or U nucleotides in the at least two RNA species to be co-purified (to be harmonized) is adapted. For example, if a mixture contains a multitude of RNA species, which are characterized by essentially the same retention time, and two or more RNA species are to be separated from the remaining RNA species (i.e. co-purified), then a target number of A and/or U nucleotides is determined, preferably as described herein, which results in the RNA species to be co-purified (or harmonized) having essentially the same retention time, thus eluting from a chromatographic column within the same fraction (peak), allowing for (co-) separation of these RNA species from the undesired RNA species in the mixture.

In order for two (or more) RNA species to elute from a chromatographic column, such as a (reversed-phase) HPLC column, within the same fraction (peak), thus allowing for co-purification of the two (or more) RNA species, preferably in an analytical scale purification, the numbers of A and/or U nucleotides in the two (or more) RNA species preferably differ from each other by not more than 1, 2, 3, 4, 5, 6, 7, 8, 9, 10, 11, 12, 13, 14, 15, 16, 17, 18, 19, 20, 21, 22, 23, 24, 25, 30 or 35. In preferred embodiments, the numbers of A and/or U nucleotides in the RNA species preferably differ from each other by not more than 2, more preferably by not more than 3, even more preferably by not more than 4, even more preferably by not more than 5, most preferably by not more than 6. In a further preferred embodiment, the numbers of A and/or U nucleotides in the RNA species differ from each other by not more than 10, preferably by not more than 15, more preferably by not more than 20, even more preferably by not more than 25, most preferably by not more than 30. It is particularly preferred, that the numbers of A and/or U nucleotides in the two or more RNA species are identical.

For preparative scale purification, in order for two (or more) RNA species to elute from a chromatographic column, such as a (reversed-phase) HPLC column, within the same fraction (peak), thus allowing for co-purification of the two (or more) RNA species, the numbers of A and/or U nucleotides in the two (or more) RNA species preferably differ from each other by not more than 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 110, 120, 130, 140, 150. In preferred embodiments, the numbers of A and/or U nucleotides in the RNA species preferably differ from each other by not more than 2, more preferably by not more than 3, even more preferably by not more than 4, even more preferably by not more than 5, most preferably by not more than 6. In a further preferred embodiment, the numbers of A and/or U nucleotides in the RNA species differ from each other by not more than 10, preferably by not more than 20, more preferably by not more than 30, even more preferably by not more than 40, most preferably by not more than 50. It is particularly preferred, that the numbers of A and/or U nucleotides in the two or more RNA species are identical.

According to a preferred embodiment, the numbers of A and/or U nucleotides in the RNA species, which are to be co-purified and which preferably have the same length, differ by a number, which is equal to or lower than the total number of nucleotides in the RNA multiplied by a factor equal to or lower than 0.008, equal to or lower than 0.0075, equal to or lower than 0.007, equal to or lower than 0.0065, equal to or lower than 0.006, equal to or lower than 0.0055, equal to or lower than 0.005, equal to or lower than 0.0045, equal to or lower than 0.004, equal to or lower than 0.0035 or equal or lower than 0.003. More preferably, the numbers of A and/or U nucleotides in the RNA species, which are to be co-purified and which preferably have the same length, differ by a number, which is equal to or lower than the total number of nucleotides in the RNA multiplied by a factor equal to or lower than 0.0065, preferably equal to or lower than 0.0063.

According to preferred embodiments, the numbers of A and/or U nucleotides in the RNA species, which are to be co-purified and which preferably have the same length, differ by a number, which is equal to or lower than the total number of nucleotides in the RNA multiplied by a factor equal to or lower than 0.030, equal to or lower than 0.025, equal to or lower than 0.020, equal to or lower than 0.015, equal to or lower than 0.014, equal to or lower than 0.013, equal to or lower than 0.012, equal to or lower than 0.011, equal to or lower than 0.010, equal to or lower than 0.009 or equal or lower than 0.008.

Modified RNA:

According preferred embodiments of the invention, the RNA (species) as described herein, may be in the form of modified RNA, wherein any modification, as defined herein, may be introduced into the RNA. A modification as defined herein preferably leads to an artificial RNA as described herein, which is further stabilized.

According to one embodiment, the RNA, may thus be provided as a 'stabilized RNA', preferably as a 'stabilized mRNA', that is to say as an RNA that is essentially resistant to in vivo degradation (e.g. by an exo- or endo-nuclease). Such stabilization can be effected, for example, by a modified phosphate backbone of an artificial RNA. A backbone modification in connection with the present invention is a modification in which phosphates of the backbone of the nucleotides contained in the RNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, each of which is preferably capable of 'stabilizing' the RNA, preferably an mRNA, as described herein.

Chemical Modifications:

The terms 'nucleic acid modification' or 'RNA modification' as used herein may refer to chemical modifications comprising backbone modifications as well as sugar modifications or base modifications.

In this context, a modified RNA as defined herein may contain nucleotide analogues/modifications, e.g. backbone modifications, sugar modifications or base modifications. A backbone modification in connection with the present invention is a modification, in which phosphates of the backbone of the nucleotides contained in the RNA as defined herein are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the artificial RNA. In this context, nucleotide analogues or modifications are preferably selected from nucleotide analogues, which are applicable for transcription and/or translation.

Sugar Modifications:

The modified nucleosides and nucleotides, which may be incorporated into a modified RNA as described herein, can be modified in the sugar moiety. For example, the 2' hydroxyl group (OH) can be modified or replaced with a number of different "wry" or "deoxy" substituents. Examples of "wry"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)$_n$CH$_2$CH$_2$OR; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and 0.

The sugar group can also contain one or more carbons that possess the opposite stereochemical configuration than that of the corresponding carbon in ribose. Thus, an RNA can include nucleotides containing, for instance, arabinose as the sugar.

Backbone Modifications:

The phosphate backbone may further be modified in the modified nucleosides and nucleotides, which may be incorporated into a modified RNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of the linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a modified nucleic acid, preferably an mRNA as described herein can further be modified in the nucleobase moiety. Examples of nucleobases found in a nucleic acid such as RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyDadenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group.

In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified RNA may comprise nucleoside modifications selected from 6-aza-cytidine, 2-thio-cytidine, alpha-thio-cytidine, Pseudo-iso-cytidine, 5-aminoallyl-uridine, 5-iodo-uridine, N1-methyl-pseudouridine, 5,6-dihydrouridine, alpha-thio-uridine, 4-thio-uridine, 6-aza-uridine, 5-hydroxy-uridine, deoxy-thymidine, 5-methyl-uridine, Pyrrolo-cytidine, inosine, alpha-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, alpha-thio-adenosine, 8-azido-adenosine, 7-deaza-adenosine.

In some embodiments, the RNA as used herein comprises at least one coding region as defined herein, wherein the coding region comprises at least one modified uridine nucleoside, preferably selected from N(1)-methylpseudouridine (m1ψ), pseudouridine (ψ), 5-methoxyuridine. Alternatively or in addition, the RNA as used herein comprises at least one coding region as defined herein, wherein the coding region comprises at least one modified cytosine nucleoside, preferably 5-methylcytosine.

Lipid Modification:

According to a further embodiment, a modified RNA as defined herein can contain a lipid modification. Such a lipid-modified RNA as defined herein typically further comprises at least one linker covalently linked with that RNA, and at least one lipid covalently linked with the respective linker. Alternatively, the lipid-modified RNA comprises at least one RNA as defined herein and at least one (bifunctional) lipid covalently linked (without a linker) with that RNA. According to a third alternative, the lipid-modified RNA comprises an RNA molecule as defined herein, at least one linker covalently linked with that RNA, and at least one lipid covalently linked with the respective linker, and also at least one (bifunctional) lipid covalently linked (without a linker) with that RNA. In this context, it is particularly preferred that the lipid modification is present at the terminal ends of a linear RNA.

Optimized Coding Sequences of the Original RNA:

The term "optimized coding sequence" relates to coding sequences that differ in at least one codon (triplets of nucleotides coding for one amino acid) compared to the corresponding wild type coding sequence. Preferably, a codon "optimized coding sequence" in the context of the invention may show improved resistance to in vivo degradation and/or improved stability in vivo, and/or improved translatability in vivo. Codon optimization in the broadest sense make use of the degeneracy of the genetic code wherein multiple codons may encode the same amino acid and may be used interchangeably to optimize/modify the coding sequence for in vivo applications (e.g. vaccination).

In particularly preferred embodiments, the at least one RNA or at least one RNA species is an mRNA comprising a coding region, wherein the coding region of the original RNA sequence comprises an optimized coding sequence, wherein the optimized coding sequence is selected from C maximized coding sequence, G/C increased coding sequence, G/C optimized coding sequence, human codon usage optimized coding sequence, CAI maximized coding sequence, or any combination thereof.

According to certain embodiments, the RNA, particularly the coding sequence of the original RNA may be optimized, wherein the C content of the at least one coding sequence may be increased, preferably maximized, compared to the C content of the corresponding wild type coding sequence (herein referred to as "C maximized coding sequence"). The amino acid sequence encoded by the C maximized coding sequence of the nucleic acid sequence is preferably not modified as compared to the amino acid sequence encoded by the respective wild type nucleic acid coding sequence. The generation of a Cytosine optimized RNA as described above may suitably be carried out using a C maximization method according to WO2015/062738. In this context, the disclosure of WO2015/062738 is included herewith by reference.

According to some embodiments, the RNA, particularly the coding sequence of the original RNA may be optimized, wherein the G/C content of the coding sequence may be increased compared to the G/C content of the corresponding wild type coding sequence (herein referred to as "G/C increased coding sequence"). The term "G/C increased coding sequence" relates to RNA, preferably the coding sequence of the original RNA of the invention that comprises an increased number of guanosine and/or cytosine nucleotides as compared to the corresponding wild type nucleic acid sequence. Such an increased number may be generated by substitution of codons containing adenosine or thymidine nucleotides by codons containing guanosine or cytosine nucleotides. If the enriched G/C content occurs in a coding sequence of DNA or RNA, it makes use of the degeneracy of the genetic code. In particular, in case of RNA, sequences having an increased G (guanosine)/C (cytosine) content are more stable than sequences having an increased A (adenosine)/U (uracil) content. The amino acid sequence encoded by the G/C content modified coding sequence of the nucleic acid sequence is preferably not modified as compared to the amino acid sequence encoded by the respective wild type nucleic acid coding sequence. Preferably, the G/C content of the original RNA coding sequence of the present invention is increased by at least 10%, preferably by at least 20%, more preferably by at least 30%, most preferably by at least 40% compared to the G/C content of the coding sequence of the corresponding wild type nucleic coding sequence.

According to preferred embodiments, the RNA, particularly the coding sequence of the original RNA may be optimized, wherein the G/C content of the coding sequence may be optimized compared to the G/C content of the corresponding wild type coding sequence (herein referred to as "G/C optimized coding sequence"). "Optimized" in that context refers to a coding sequence wherein the G/C content is preferably increased to the essentially highest possible G/C content. The amino acid sequence encoded by the G/C content optimized coding sequence of the nucleic acid sequence is preferably not modified as compared to the amino acid sequence encoded by the respective wild type nucleic acid coding sequence. The generation of a G/C optimized RNA sequences as described above may suitably be carried out using a G/C optimization method explained in WO2002/098443. In this context, the disclosure of WO2002/098443 is included in its full scope in the present invention.

In particularly preferred embodiments, the at least one RNA or at least one RNA species is an mRNA comprising a coding region, wherein the at least one coding region of the original RNA sequence comprises a nucleic acid sequence, which is G/C optimized.

According to preferred embodiments, the RNA, particularly the coding sequence of the original RNA may be optimized, wherein the codons coding sequence may be optimized to the human codon usage (herein referred to as "human codon usage optimized coding sequence"). Codons encoding the same amino acid occur at different frequencies in a subject, e.g. a human. Accordingly, the coding sequence of the RNA as defined herein is preferably optimized such that the frequency of the codons encoding the same amino acid corresponds to the naturally occurring frequency of that codon according to the human codon usage. For example, in the case of the amino acid Alanine (Ala), the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. Accordingly, such a procedure (as exemplified for Ala) is applied for each amino acid encoded by the coding sequence of the RNA, preferably the original RNA.

According to preferred embodiments, the RNA, particularly the coding sequence of the original RNA may be optimized, wherein the codon adaptation index (CAI) may be increased or preferably maximised (herein referred to as "CAI maximized coding sequence"). Accordingly, it is preferred that all codons of the wild type sequence that are relatively rare in the cell (e.g. a human) are exchanged for a respective codon that is frequent in the cell, wherein the frequent codon encodes the same amino acid as the relatively rare codon. Suitably, the most frequent codons are used for each encoded amino acid. Suitably, the RNA, preferably the original RNA of the present invention comprises at least one coding sequence, wherein the codon adaptation index (CAI) of the at least one coding sequence is at least 0.5, at least 0.8, at least 0.9 or at least 0.95. Most preferably, the codon adaptation index (CAI) of the at least one coding sequence is 1. For example, in the case of the amino acid alanine (Ala) present in the amino acid sequence encoded by the at least one coding sequence of the nucleic acid sequence according to the invention, the wild type coding sequence is adapted in a way that the most frequent human codon "GCC" is always used for said amino acid. Accordingly, such a procedure (as exemplified for Ala) is applied for each amino acid encoded by the coding sequence of the RNA, preferably the original RNA to obtain CAI maximized coding sequences.

5'-Cap Structure

According to another preferred embodiment of the invention, the RNA as used herein may be modified by the addition of a 5'-cap structure, which preferably stabilizes the RNA as described herein.

The term "5'-cap structure" as used herein will be recognized and understood by the person of ordinary skill in the art, and is for example intended to refer to a modified nucleotide (cap analogue), particularly a guanine nucleotide, added to the 5' end of an RNA molecule, e.g. an mRNA molecule. Preferably, the 5'-cap is added using a 5'-5'-triphosphate linkage (also named m7GpppN). Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted a basic moiety, 3'-2'-inverted nucleotide moiety, 3'-2'-inverted a basic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. Further modified 5'-cap structures which may be used in the context of the present invention are cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deazaguanosine, 8-oxo-guanosine, 2-amino-guanosine, LNA-guanosine, and 2-azido-guanosine.

A 5' cap (cap0 or cap1) structure may also be formed in chemical RNA synthesis or RNA in vitro transcription (co-transcriptional capping) using cap analogues.

The term "cap analogue" as used herein will be recognized and understood by the person of ordinary skill in the art, and is for example intended to refer to a non-polymerizable di-nucleotide that has cap functionality in that it facilitates translation or localization, and/or prevents degradation of a nucleic acid molecule, particularly of an RNA molecule, when incorporated at the 5' end of the nucleic acid molecule. Non-polymerizable means that the cap analogue will be incorporated only at the 5' terminus because it does not have a 5' triphosphate and therefore cannot be extended in the 3' direction by a template-dependent polymerase, particularly, by template-dependent RNA polymerase. Examples of cap analogues include, but are not limited to, a chemical structure selected from the group consisting of m7GpppG, m7GpppA, m7GpppC; unmethylated cap analogues (e.g., GpppG); dimethylated cap analogue (e.g., m2,7GpppG), trimethylated cap analogue (e.g., m2,2,7GpppG), dimethylated symmetrical cap analogues (e.g., m7Gpppm7G), or anti reverse cap analogues (e.g., ARCA; m7,2'OmeGpppG, m7,2'dGpppG, m7,3'OmeGpppG, m7,3'dGpppG and their tetraphosphate derivatives). Further cap analogues have been described previously (WO2008/016473, WO2008/157688, WO2009/149253, WO2011/015347, and WO2013/059475). Further suitable cap analogons in that context are described in WO2017/066793, WO2017/066781, WO2017/066791, WO2017/066789, WO2017/066782, WO2017/066797, wherein the disclosures referring to cap analogues are incorporated herewith by reference.

In a preferred embodiment, the 5'-cap structure is added co-transcriptionally using cap-analogues, preferably as defined herein, in an RNA in vitro transcription reaction as described herein. Preferred cap-analogues in the context of the invention are m7G(5')ppp(5')G (m7G) or 3'-O-Me-m7G (5')ppp(5')G. Further preferred cap-analogues in the context of the invention are m7G(5')ppp(5')(2'OMeA)pG or m7G (5')ppp(5')(2'OMeG)pG to co-transcriptionally generate cap1 structures.

In another embodiment, the 5'-cap structure is added via enzymatic capping using capping enzymes (e.g. vaccinia virus capping enzymes, commercially available capping kits) to generate cap0 or cap1 or cap2 structures. In other embodiments, the 5'-cap structure (cap0, cap1) is added via enzymatic capping using immobilized capping enzymes, e.g. in a capping reactor (WO2016/193226).

m7GpppN (cap0), cap1 and cap2 are 5'-cap structure naturally occurring in RNA transcribed by polymerase II and is therefore not considered as modification comprised in a modified RNA in this context. Accordingly, a modified RNA sequence of the present invention may comprise a cap0, cap1 or cap2, but additionally the modified RNA sequence may comprise at least one further modification as defined herein.

Poly(A) Sequence

According to another preferred embodiment of the invention, the RNA as used herein may contain a poly(A) sequence or a poly(A) tail.

The terms "poly(A) sequence", "poly(A) tail" or "3'-poly (A) tail" are recognized and understood by the person of ordinary skill in the art, and are for example intended to be a sequence of adenosine nucleotides, typically located at the 3'-end of an RNA, of up to about 400 adenosine nucleotides.

In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector.

In a preferred embodiment, the poly(A) sequence, suitable located at the 3' terminus, is typically about 10 to 200 adenosine nucleotides, preferably about 10 to 100 adenosine nucleotides, more preferably about 40 to 80 adenosine nucleotides or even more preferably about 50 to 70 adenosine nucleotides. Preferably, the poly(A) sequence in the RNA as used herein is derived from a DNA template by RNA in vitro transcription.

In other embodiments, the poly(A) sequence is obtained in vitro by common methods of chemical synthesis without being necessarily transcribed from a DNA template.

In further embodiments, poly(A) sequences are generated by enzymatic polyadenylation of the RNA (after RNA in vitro transcription) using commercially available polyadenylation kits and corresponding protocols known in the art, or alternatively, by using immobilized poly(A) polymerases, e.g. in a polyadenylation reactor (as described in WO2016174271).

Alternatively, the RNA as used herein may comprise a polyadenylation signal. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called pre-mature-mRNA). In this context, a consensus polyadenylation signal is preferred comprising the NN(U/T)ANA consensus sequence. In a particularly preferred embodiment, the polyadenylation signal comprises one of the following sequences: AA(U/T)AAA or A(U/T)(U/T)AAA (wherein uridine is usually present in RNA and thymidine is usually present in DNA).

In some embodiments, the RNA as used herein may contain a poly(A) sequence derived from a vector and at least one additional poly(A) sequence generated by enzymatic polyadenylation, e.g. as described in WO2016/091391.

Poly(C) Sequence

According to a further preferred embodiment, the RNA as used herein may contain a poly(C) sequence. The term "poly(C) sequence" has to be understood as a long sequence of cytosine nucleotides, typically about 10 to about 200 cytosine nucleotides, preferably about 10 to about 100 cytosine nucleotides, more preferably about 10 to about 70 cytosine nucleotides or even more, preferably about 20 to about 50, or even about 20 to about 30 cytosine nucleotides. A poly(C) sequence may preferably be located 3' of the coding sequence comprised by a nucleic acid. Preferably, the poly(C) sequence in the RNA as used herein is derived from a DNA template by RNA in vitro transcription.

UTRs

In a preferred embodiment, the at least one RNA or the at least one RNA species comprises a 3'-UTR and/or a 5'-UTR. Preferably, a 3'-UTR or a 5'-UTR as used herein comprises one or more 3'-UTR elements or 5'-UTR elements, respectively. Accordingly, the RNA as used herein may comprise at least one 5'-UTR element and/or at least one 3'-UTR element. In this context, an UTR element comprises or consists of a nucleic acid sequence, which is derived from a 5'-UTR or 3'-UTR of any naturally occurring gene or which is derived from a fragment, a homolog or a variant of the 5'-UTR or 3'-UTR of a gene. Preferably, the 5'-UTR or 3'-UTR element used in the context of the present invention is heterologous to the at least one coding sequence of the RNA as used herein. 5'-UTR or 3'-UTR elements are preferably derived from naturally occurring genes. In other embodiments, synthetically engineered 5'-UTR or 3'-UTR elements may be used in the context of the present invention.

The term "3'-untranslated region (3'-UTR)" will be recognized and understood by the person of ordinary skill in the art, and are for example intended to refer to a part of a nucleic acid molecule, which is located 3' (i.e. "downstream") of a coding sequence and which is typically not translated into protein. Usually, a 3'-UTR is the part of an mRNA which is located between the coding sequence (cds) and the poly(A) sequence of the mRNA. In the context of the invention, the term 3'-UTR may also comprise elements, which are not encoded in the DNA template, from which RNA is transcribed, but which are added after transcription during maturation, e.g. a poly(A) sequence.

The term "5'-untranslated region (5'-UTR)" will be recognized and understood by the person of ordinary skill in the art, and are for example intended to refer to a part of a nucleic acid molecule, which is located 5' (i.e. "upstream") of a coding sequence and which is not translated into protein. A 5'-UTR is typically understood to be a particular section of messenger RNA (mRNA), which is located 5' of the coding sequence of the mRNA. Typically, the 5'-UTR starts with the transcriptional start site and ends one nucleotide before the start codon of the coding sequence. Preferably, the 5'-UTRs have a length of more than 20, 30, 40 or 50 nucleotides. The 5'-UTR may comprise elements for controlling gene expression, also called regulatory elements. Such regulatory elements may be, for example, ribosomal binding sites. The 5'-UTR may be post-transcriptionally modified, for example by addition of a 5'-cap.

3'-UTR Elements

In a preferred embodiment, the RNA as used herein may comprise at least one 3'-UTR element, which is typically located within the 3'-UTR of the RNA as described herein.

Preferably, the 3'-UTRs in the context of the invention are heterologous to the coding sequence. More preferably, the RNA as used herein, preferably the 3'UTR of the RNA as used herein, comprises at least one heterologous 3'-UTR element.

Preferably, the at least one 3'-UTR element comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the RNA as used herein comprises a 3'-UTR element, preferably as described herein, which may be derivable from a gene that relates to RNA with an enhanced half-life (that provides a stable RNA). Preferably, the 3' UTR element is a nucleic acid sequence derived from a 3' UTR of a gene, which preferably encodes a stable RNA, or from a homolog, a fragment or a variant of said gene In a particularly preferred embodiment, the 3'-UTR element comprises or consists of a nucleic acid sequence, which is derived from a 3'-UTR of a gene selected from the group consisting of an albumin gene, an alpha-globin gene, a beta-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an alpha-globin gene, a beta-globin gene, a tyrosine hydroxylase gene, a lipoxygenase gene, and a collagen alpha gene, such as a collagen alpha 1(I) gene according to SEQ ID NOs: 1369-1393 of the patent application WO2013/143700, or from a homolog, a fragment or a variant thereof. Particularly preferred are 3'-UTR sequences according to SEQ ID NO: 1369 (Human albumin 3'-UTR) and SEQ ID NO: 1376 (albumin7 3'-UTR) of the patent application WO2013/143700. In this context, the disclosure of WO2013/143700 is incorporated herein by reference. Alternatively, the RNA as used herein preferably comprises a 3'-UTR element, which comprises or consists of a nucleic acid sequence selected from SEQ ID NOs: 30572, 30574, 30576, 30578, 30580, 30582 or 30584 or a fragment or variant thereof.

In other embodiments, the RNA as used herein comprises a 3'-UTR element according to any one of SEQ ID NOs: 10 to 205 of WO2015/101414 and SEQ ID NO: 1 and 2 of WO2015/101415. In this context, the disclosures of WO2015/101414 and WO2015/101415 are incorporated herewith by reference.

In some embodiments, the RNA used herein comprises a 3'-UTR element, which may be any 3'-UTR element described in WO2016/107877. In this context, the disclosure of WO2016/107877 relating to 3'-UTR elements/sequences is herewith incorporated by reference. Particularly preferred 3'-UTR elements are SEQ ID NOs: 1 to 24 and SEQ ID NOs: 49 to 318 of the patent application WO2016/107877, or fragments or variants of these sequences. In this context, it is particularly preferred that the 3'-UTR element of the RNA sequence according to the present invention comprises or consists of a corresponding RNA sequence of the nucleic acid sequence according SEQ ID NOs: 1 to 24 and SEQ ID NOs: 49 to 318 of the patent application WO2016/107877.

In certain embodiments, the RNA as defined herein comprises a 3'-UTR element, which may be any 3'-UTR element as described in WO2017/036580. In this context, the disclosure of WO2017/036580 relating to 3'-UTR elements/sequences is herewith incorporated by reference. Particularly preferred 3'-UTR elements are nucleic acid sequences according to SEQ ID NOs: 152 to 204 of the patent application WO2017/036580, or fragments or variants of these sequences. In this context, it is particularly preferred that the 3'-UTR element of the RNA sequence according to the present invention comprises or consists of a corresponding RNA sequence of the nucleic acid sequence according SEQ ID NOs: 152 to 204 of the patent application WO2017/036580.

Further, particularly suitable 3'-UTRs are disclosed in WO2018172556. The disclosure of WO2018172556, in particular relating to GNAS, CASP1, PSMB3, ALB, COX6B1, NDUFA1 and RPS9, is included herewith by reference. Preferred 3'-UTR elements are derived from GNAS, CASP1, PSMB3, ALB, COX6B1, NDUFA1 or RPS9. Particularly preferred 3'-UTR elements are nucleic acid sequences according to SEQ ID NOs: 23 to 36 as disclosed in WO2018172556, or fragments or variants of these sequences.

5'-UTR Elements

In a preferred embodiment, the RNA as used herein may comprise at least one 5'-UTR element, which is typically located within the 5'-UTR of the RNA as described herein.

Preferably, the 5'-UTRs in the context of the invention are heterologous to the coding sequence. More preferably, the RNA as used herein, preferably the 5'UTR of the RNA as used herein, comprises at least one heterologous 5'-UTR element.

In preferred embodiments, the RNA as used herein comprises at least one 5'-UTR element. Preferably, the at least one 5'-UTR element comprises or consists of a nucleic acid sequence derived from the 5'-UTR of a chordate gene, preferably a vertebrate gene, more preferably a mammalian gene, most preferably a human gene, or from a variant of the 5'-UTR of a chordate gene, preferably a vertebrate gene, more preferably a mammalian gene, most preferably a human gene.

In certain embodiments, the RNA as used herein comprises at least one 5'-UTR element, which may be any 5'-UTR element as described in the patent application WO2013/143700. Suitably, the at least one 5'-UTR element is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143700. In this context, the disclosure of WO2013/143700 is incorporated herewith by reference.

In preferred embodiments, the RNA as used herein comprises at least one heterologous 5'-UTR element, which comprises or consists of a nucleic acid sequence, which is derived from the 5'-UTR of a TOP gene, preferably from a corresponding RNA sequence, or a homolog, a fragment, or a variant thereof, preferably lacking the 5'TOP motif. More preferably, the at least one heterologous 5'-UTR element comprises or consists of a nucleic acid sequence, which is derived from a 5'-UTR of a TOP gene encoding a ribosomal protein, preferably from a corresponding RNA sequence, or a homolog, a fragment or a variant of said nucleic acid sequence, preferably lacking the 5'TOP motif In preferred embodiments, the at least one 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'-TOP motif.

In some embodiments, the at least one 5'-UTR element, preferably a heterologous 5'-UTR element, comprises or consists of a nucleic acid sequence, which is derived from a 5'-UTR of a TOP gene encoding a ribosomal Large protein (RPL), preferably from RPL32 or RPL35A, or from a gene selected from the group consisting of HSD17B4, ATP5A1, AIG1, COXC6 or ABCB7(MDR), or from a homolog, a fragment or variant of any one of these genes, preferably lacking the 5'TOP motif.

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'-TOP motif.

In a preferred embodiment, the 5'-UTR element comprises or consists of a nucleic acid sequence, according SEQ ID NO: 1368 of the patent application WO2013/143700, or preferably to a corresponding RNA sequence, or fragments or variants thereof. In another preferred embodiment, the 5'-UTR element comprises or consists of a nucleic acid sequence according to SEQ ID NOs: 1412-1420 of the patent application WO2013/143700, or a corresponding RNA sequence, or fragments or variants thereof.

Alternatively, the 5'-UTR element preferably comprises or consists of a nucleic acid sequence according to SEQ ID NO: 30570 as disclosed herein, or a fragment or variant thereof.

In some embodiments, the RNA as used herein comprises a 5'-UTR element, which may be any 5'-UTR element described in WO2016/107877. In this context, the disclosure of WO2016/107877 relating to 3'-UTR elements/sequences is herewith incorporated by reference. Particularly preferred 5'-UTR elements are nucleic acid sequences according to SEQ ID NOs: 25 to 30 and SEQ ID NOs: 319 to 382 of the patent application WO2016/107877, or fragments or variants of these sequences. In this context, it is particularly preferred that the 5'-UTR element of the RNA sequence according to the present invention comprises or consists of a corresponding RNA sequence of the nucleic acid sequence according SEQ ID NOs: 25 to 30 and SEQ ID NOs: 319 to 382 of the patent application WO2016/107877.

In some embodiments, the RNA as used herein comprises a 5'-UTR element, which may be any 5'-UTR element as described in WO2017/036580. In this context, the disclosure of WO2017/036580 relating to 3'-UTR elements/sequences is herewith incorporated by reference. Particularly preferred 5'-UTR elements are nucleic acid sequences according to SEQ ID NOs: 1 to 151 of the patent application WO2017/036580, or fragments or variants of these sequences. In this context, it is particularly preferred that the 5'-UTR element of the RNA sequence according to the present invention comprises or consists of a corresponding RNA sequence of the nucleic acid sequence according to SEQ ID NOs: 1 to 151 of the patent application WO2017/036580.

Further, particularly suitable 5'-UTRs are disclosed in WO2018172556. The disclosure of WO2018172556, in particular relating to SLC7A3, ATP5A1, RPL32, HSD17B4, NOSIP, ASAH1, RPL31, TUBB4B, UBQLN2, MP68 and NDUFA4, is included herewith by reference. Preferred 3'-UTR elements are derived from SLC7A3, ATP5A1, RPL32, HSD17B4, NOSIP, ASAH1, RPL31, TUBB4B, UBQLN2, MP68 or NDUFA4. Particularly preferred 3'-UTR elements are nucleic acid sequences according to SEQ ID NOs: 1 to 22 as disclosed in WO2018172556, or fragments or variants of these sequences.

Preferably, the at least one 5'-UTR element as defined herein and the at least one 3'-UTR element as defined herein act synergistically to increase protein production from the at least one RNA sequence as described above.

Histone Stem-Loop

In a particularly preferred embodiment, the RNA as used herein comprises a histone stem-loop sequence/structure. The term "histone stem-loop" as used herein will be recognized and understood by the person of ordinary skill in the art, and are for example intended to refer to nucleic acid sequences that are predominantly found in histone histone mRNAs. Exemplary histone stem-loop sequences are described in Lopez et al. (Davila Lopez, M., & Samuelsson, T. (2008), RNA, 14(1)). The stem-loops in histone pre-mRNAs are typically followed by a purine-rich sequence known as the histone downstream element (HDE). These pre-mRNAs are processed in the nucleus by a single endonucleolytic cleavage approximately 5 nucleotides downstream of the stem-loop, catalyzed by the U7 snRNP through base pairing of the U7 snRNA with the HDE.

Such histone stem-loop sequences are preferably selected from histone stem-loop sequences as disclosed in WO2012/019780, the disclosure relating to histone stem-loop sequences/structures incorporated herewith by reference.

A histone stem-loop sequence suitable to be used within the present invention is preferably derived from formulae (I) or (II) of the patent application WO2012/019780. According to a further preferred embodiment the RNA as defined herein may comprise at least one histone stem-loop sequence derived from at least one of the specific formulae (Ia) or (IIa) of the patent application WO2012/019780.

A particular preferred histone stem-loop sequence is the nucleic acid sequence according to SEQ ID NO: 30586 disclosed herein, or the sequence CAAAGGCTCTTTTCAGAGCCACCA (according to SEQ ID NO: 43 of the patent application WO2015024667) or more preferably the corresponding RNA sequence CAAAGGCUCUUUUCAGAGCCACCA (according to SEQ ID NO: 44 of the patent application WO2015024667).

Any of the above modifications may be applied to the RNA (or RNA species) in the context of the present invention and may be, if suitable or necessary, be combined with each other in any combination, provided, these combinations of modifications do not interfere with each other in the respective nucleic acid sequence. A person skilled in the art will be able to take his choice accordingly.

Accordingly, the RNA as used herein may comprise a 5'-UTR and/or a 3'-UTR preferably comprising at least one histone stem-loop. The 3'-UTR of the RNA as used herein preferably comprises also a poly(A) and/or a poly(C) sequence, preferably as defined herein. The single elements of the 3' UTR may occur therein in any order from 5' to 3' along the sequence of the RNA sequence of the present invention. In addition, further elements as described herein, may also be contained, such as a stabilizing sequence as defined herein (e.g. derived from the UTR of a globin gene), IRES sequences, miRNA binding sites etc. Each of the elements may also be repeated in the RNA as used herein at least once (particularly in di- or multicistronic constructs), preferably twice or more.

In a preferred embodiment, the RNA (RNA species) as used herein is monocistronic, bicistronic or multicistronic. Preferably, the RNA comprises at least two coding regions and at least one IRES sequence.

Accordingly, in a preferred embodiment, the RNA as used herein comprises, preferably in 5'- to 3'-direction:
a) a 5'-cap structure (cap0, cap1, cap2), preferably m7GpppN (cap0);
b) optionally, a 5'-UTR element as defined herein;
c) at least one coding sequence;
d) a 3'-UTR element as defined herein;
e) optionally, a poly(A)sequence, preferably comprising 10 to 200, 10 to 100, 40 to 80 or 50 to 70 adenine nucleotides, more preferably comprising 64 adenine nucleotides;
f) optionally, a poly(C)sequence, preferably consisting of 10 to 200, 10 to 100, 20 to 70, 20 to 60 or 10 to 40 cytosine nucleotides, more preferably comprising 30 cytosine nucleotides;
g) optionally, a histone stem-loop;
h) optionally, an additional poly(A) sequence;
or a fragment or variant of any of these nucleic acid sequences.

In certain embodiments, the RNA (or RNA species) as used herein comprises, preferably in 5' to 3' direction, the following elements:
a) a 5'-cap structure, preferably m7GpppN,
b) at least one coding region;
c) a 3'-UTR element comprising a nucleic acid sequence, which is derived from an alpha-globin gene, preferably comprising the nucleic acid sequence according to SEQ ID NO: 30578, or a homolog, a fragment or a variant of any one of these nucleic acid sequences,
d) a poly(A)sequence, preferably comprising 10 to 200, 10 to 100, 40 to 80 or 50 to 70 adenine nucleotides, more preferably comprising 64 adenine nucleotides,
e) a poly(C)sequence, preferably consisting of 10 to 200, 10 to 100, 20 to 70, 20 to 60 or 10 to 40 cytosine nucleotides, more preferably comprising 30 cytosine nucleotides, and
f) a histone stem-loop, preferably comprising the nucleic acid sequence according to SEQ ID NO. 30586, or a fragment or variant of any one of these nucleic acid sequences.

According to some preferred embodiments, the RNA (or RNA species) as used herein comprises, preferably in 5' to 3' direction, the following elements:
a) a 5'-cap structure, preferably m7GpppN,
b) a 5'-UTR element, which comprises a nucleic acid sequence, which is derived from the 5'-UTR of a TOP gene, preferably comprising a nucleic acid sequence according to SEQ ID NO: 30570, or a homolog, a fragment or a variant of any one of these nucleic acid sequences,
c) at least one coding region,
d) a 3'-UTR element comprising a nucleic acid sequence, which is derived from an albumin gene, preferably comprising the corresponding RNA sequence of the nucleic acid sequence according to SEQ ID NO: 30582 or 30584, or a homolog, a fragment or a variant of any one of these nucleic acid sequences,
e) a poly(A)sequence, preferably comprising 10 to 200, 10 to 100, 40 to 80 or 50 to 70 adenine nucleotides, more preferably comprising 64 adenine nucleotides,
f) a poly(C)sequence, preferably consisting of 10 to 200, 10 to 100, 20 to 70, 20 to 60 or 10 to 40 cytosine nucleotides, more preferably comprising 30 cytosine nucleotides, and
g) a histone stem-loop, preferably comprising the nucleic acid sequence according to SEQ ID NO. 30586, or a fragment or variant of any one of these nucleic acid sequences.

The at least one coding region (or coding sequence) of the RNA (or RNA species) that is adapted according to the methods disclosed herein, preferably encodes a peptide or a protein.

In preferred embodiments, the at least one coding region encodes an antigen derived from a pathogen causing an infectious disease, or a fragment or variant of such an antigen. More preferably, the at least one coding region encodes a viral antigen, a bacterial antigen, a fungal antigen or a protozoan antigen, or a fragment or variant of any one of these antigens.

In this context, further preferred are antigens derived from pathogens selected from the group consisting of *Acinetobacter baumannii, Anaplasma genus, Anaplasma phagocytophilum, Ancylostoma braziliense, Ancylostoma duodenale, Arcanobacterium haemolyticum, Ascaris lumbricoides, Aspergillus* genus, Astroviridae, *Babesia* genus, *Bacillus anthracis, Bacillus cereus, Bartonella henselae,* BK virus, *Blastocystis hominis, Blastomyces dermatitidis, Bordetella pertussis, Borrelia burgdorferi, Borrelia* genus, *Borrelia* spp, *Brucella* genus, *Brugia malayi,* Bunyaviridae family, *Burkholderia cepacia* and other *Burkholderia* species, *Burkholderia mallei, Burkholderia pseudomallei,* Caliciviridae family, *Campylobacter* genus, *Candida albicans, Candida* spp, *Chlamydia trachomatis, Chlamydophila pneumoniae, Chlamydophila psittaci,* CJD prion, *Clonorchis sinensis,*

*Clostridium botulinum, Clostridium difficile, Clostridium perfringens, Clostridium perfringens, Clostridium* spp., *Clostridium tetani, Coccidioides* spp, coronaviruses, *Corynebacterium diphtheriae, Coxiella burnetii,* Crimean-Congo hemorrhagic fever virus, *Cryptococcus neoformans, Cryptosporidium* genus, Cytomegalovirus (CMV), Dengue viruses (DEN-1, DEN-2, DEN-3 and DEN-4), *Dientamoeba fragilis,* Ebolavirus (EBOV), *Echinococcus* genus, *Ehrlichia chaffeensis, Ehrlichia ewingii, Ehrlichia* genus, *Entamoeba histolytica, Enterococcus* genus, Enterovirus genus, Enteroviruses, mainly Coxsackie A virus and Enterovirus 71 (EV71), *Epidermophyton* spp, Epstein-Barr Virus (EBV), *Escherichia coli* O157:H7, O111 and O104:H4, *Fasciola hepatica* and *Fasciola gigantica,* FFI prion, Filarioidea superfamily, Flaviviruses, *Francisella tularensis, Fusobacterium* genus, *Geotrichum candidum, Giardia intestinalis, Gnathostoma* spp, GSS prion, Guanarito virus, *Haemophilus ducreyi, Haemophilus influenzae, Helicobacter pylori,* Henipavirus (Hendra virus Nipah virus), Hepatitis A Virus, Hepatitis B Virus (HBV), Hepatitis C Virus (HCV), Hepatitis D Virus, Hepatitis E Virus, Herpes simplex virus 1 and 2 (HSV-1 and HSV-2), *Histoplasma capsulatum,* HIV (Human immunodeficiency virus), *Hortaea werneckii,* Human bocavirus (HBoV), Human herpesvirus 6 (HHV-6) and Human herpesvirus 7 (HHV-7), Human metapneumovirus (hMPV), Human papillomavirus (HPV), Human parainfluenza viruses (HPIV), Japanese encephalitis virus, JC virus, Junin virus, Kingella kingae, *Klebsiella granulomatis,* Kuru prion, Lassa virus, *Legionella pneumophila, Leishmania* genus, Leptospira genus, *Listeria monocytogenes,* Lymphocytic choriomeningitis virus (LCMV), Machupo virus, *Malassezia* spp, Marburg virus, Measles virus, *Metagonimus yokagawai,* Microsporidia phylum, Molluscum contagiosum virus (MCV), Mumps virus, *Mycobacterium leprae* and *Mycobacterium* lepromatosis, *Mycobacterium tuberculosis, Mycobacterium ulcerans, Mycoplasma pneumoniae, Naegleria fowleri, Necator americanus, Neisseria gonorrhoeae, Neisseria meningitidis, Norovirus, Nocardia asteroides, Nocardia* spp, *Onchocerca volvulus,* Orientia tsutsugamushi, Orthomyxoviridae family (Influenza), *Paracoccidioides brasiliensis, Paragonimus* spp, *Paragonimus westermani,* Parvovirus B19, *Pasteurella* genus, *Plasmodium* genus, *Pneumocystis jirovecii,* Poliovirus, Rabies virus, Respiratory syncytial virus (RSV), Rhinovirus, rhinoviruses, *Rickettsia akari, Rickettsia* genus, *Rickettsia prowazekii, Rickettsia rickettsii, Rickettsia typhi,* Rift Valley fever virus, Rotavirus, Rubella virus, Sabia virus, *Salmonella* genus, *Sarcoptes scabiei,* SARS coronavirus, *Schistosoma* genus, *Shigella* genus, Sin Nombre virus, Hantavirus, *Sporothrix schenckii, Staphylococcus* genus, *Staphylococcus* genus, *Streptococcus agalactiae, Streptococcus pneumoniae, Streptococcus pyogenes, Strongyloides stercoralis, Taenia* genus, *Taenia solium,* Tick-borne encephalitis virus (TBEV), *Toxocara canis* or *Toxocara cati, Toxoplasma gondii, Treponema pallidum, Trichinella spiralis, Trichomonas vaginalis, Trichophyton* spp, *Trichuris trichiura, Trypanosoma brucei, Trypanosoma cruzi, Ureaplasma urealyticum,* Varicella zoster virus (VZV), Varicella zoster virus (VZV), Variola major or Variola minor, vCJD prion, Venezuelan equine encephalitis virus, *Vibrio cholerae,* West Nile virus, Western equine encephalitis virus, *Wuchereria bancrofti, Yersinia enterocolitica, Yersinia pestis,* and *Yersinia pseudotuberculosis,* preferably the pathogen is selected from the group consisting of influenza virus, respiratory syncytial virus (RSV), Herpes simplex virus (HSV), human Papilloma virus (HPV), Human immunodeficiency virus (HIV), *Plasmodium, Staphylococcus aureus,* Dengue virus, *Chlamydia trachomatis,* Cytomegalovirus (CMV), Hepatitis B virus (HBV), *Mycobacterium tuberculosis,* Rabies virus, Rotavirus and Yellow Fever Virus, Zika virus.

According to a particularly preferred embodiment, the at least one coding region encodes an antigen, or a fragment or variant thereof, derived from an influenza virus, more preferably from an influenza A, an influenza B, or an influenza C virus (strain) or a variant of any of these.

In this context it, is particularly preferred that the at least one coding region of the RNA used herein encodes at least one antigen, or a fragment or variant thereof, selected from the group consisting of hemagglutinin (HA), neuraminidase (NA), nucleoprotein (NP), matrix protein 1 (M1), matrix protein 2 (M2), non-structural protein 1 (NS1), non-structural protein 2 (NS2), nuclear export protein (NEP), polymerase acidic protein (PA), polymerase basic protein PB1, PB1-F2, or polymerase basic protein 2 (PB2) of an influenza virus or a variant thereof. In some embodiments, the at least one coding region of the RNA used herein encodes at least one antigenic peptide or protein, or a fragment or variant thereof, which is derived from any one of the influenza virus proteins mentioned herein.

In a preferred embodiment, the at least one coding region of the RNA used herein encodes at least one antigen selected from hemagglutinin (HA) and/or neuraminidase (NA) of an influenza virus, or a fragment or variant thereof. More preferably, the at least one coding region of the RNA used herein encodes at least one antigenic peptide or protein derived from hemagglutinin (HA) and/or neuraminidase (NA) of an influenza virus, or a fragment or variant thereof. In this context, the hemagglutinin (HA) and the neuraminidase (NA) may be chosen from the same influenza virus or from different influenza viruses (or different influenza virus strains, respectively).

Influenza antigens and antigenic peptides or proteins derived from influenza virus are described in international patent applications PCT/EP2016/075862 and PCT/EP2017/060663, which are hereby incorporated by reference in their entirety.

In preferred embodiments, the RNA (species) as used herein, preferably the original RNA (species) that is to be adapted according to the methods disclosed herein or the adapted RNA (species), comprises at least one coding region, which encodes a peptide or protein comprising or consisting of an amino acid sequence according to any one of SEQ ID NOs: SEQ ID NOs: 1-30504, 213713, 213738, 213739, 213787, 213792, 213797, 213802, 213996-214023, 214100-214127, 214212-214239, 214316-214343, 214420-214447, 214524-214551, 214628-214655, 214732-214759, 214836-214863, 214940-214967, 215044, 215049-215076, 215161, 215166-215193, 215278, 215283-215310, 215395, 215400-215427, 215512, 215517-215544 as described in PCT/EP2017/060663, or a fragment or variant of any one of these amino acid sequences.

According to some embodiments, the RNA (species) used herein, preferably the original RNA (species) that is to be adapted, comprises at least one coding region comprising or consisting of a nucleic acid sequence according to any one of SEQ ID NOs: 30505-213528, 213529-213557, 213740-213746, 213788, 213789, 213793, 213794, 213798, 213799, 213803, 213804, 214024-214051, 214128-214155, 214240-214267, 214344-214371, 214448-214475, 214552-214579, 214656-214683, 214760-214787, 214864-214891, 214968-214995, 215045, 215046, 215077-215104, 215162, 215163, 215194-215221, 215279, 215280, 215311-215338, 215396, 215397, 215428-215455, 215513, 215514, 215545-215572, 215629, 215632, 215638-215835, 215892, 215836-215889 as described in PCT/EP2017/060663, or a fragment or variant of any one of these nucleic acid sequences.

According to a further preferred embodiment, the RNA (species) used herein comprises at least one coding region encoding an antigen, or a fragment or variant thereof, derived from a Norovirus, preferably selected from a GI.1 to GI.17 Norovirus, GII.1 to GII.24 Norovirus, GIII.1 to GIII.4 Norovirus, GIV.1 to GIV.4 Norovirus and GV.1 to GV.4 Norovirus more preferably, from a Norovirus selected from the group consisting of GI.1 Norovirus and GII.4 Norovirus or a variant of any of these.

In this context it, is particularly preferred that the at least one coding region of the RNA used herein encodes at least one antigen, or a fragment or variant thereof, selected from the group consisting of Norovirus non-structural proteins NS1/NS2, NS3, NS4, NS5, NS6, NS7, Norovirus capsid protein VP1 and Norovirus capsid protein VP2 or a variant thereof. In some embodiments, the at least one coding region of the RNA used herein encodes at least one antigenic peptide or protein, or a fragment or variant thereof, which is derived from any one of the Norovirus proteins mentioned herein.

In a preferred embodiment, the at least one coding region of the RNA used herein encodes at least one antigen selected from Norovirus capsid protein VP1 or Norovirus capsid protein VP2 or a fragment or variant thereof. In this context, the Norovirus capsid protein VP1 and/or Norovirus capsid protein VP2 may be chosen from the same Norovirus or from different Noroviruses (or different Norovirus strains, respectively). Norovirus antigens and antigenic peptides or proteins derived from Norovirus are also described in international patent application PCT/EP2017/060673, which is hereby incorporated by reference in its entirety.

In preferred embodiments, the RNA (species) as used herein, preferably the original RNA (species) that is to be adapted according to the methods disclosed herein or the adapted RNA (species), comprises at least one coding region, which encodes a peptide or protein (derived from a Norovirus) comprising or consisting of an amino acid sequence according to any one of SEQ ID NOs: 1-4410 as described in PCT/EP2017/060673, or a fragment or variant of any one of these amino acid sequences.

According to some embodiments, the RNA (species) used herein, preferably the original RNA (species) that is to be adapted, comprises at least one coding region comprising or consisting of a nucleic acid sequence according to any one of SEQ ID NOs: 4411-39690, 39713-39746 as described in PCT/EP2017/060673, or a fragment or variant of any one of these nucleic acid sequences.

According to some embodiments, the RNA (species) used herein, preferably the original RNA (species) that is to be adapted or the adapted RNA (species), comprises at least one coding region encoding a tumor antigen. Suitably, the tumor antigen is selected from the list consisting of 5T4, 707-AP, 9D7, AFP, AlbZIP HPG1, alpha-5-beta-1-integrin, alpha-5-beta-6-integrin, alpha-actinin-4/m, alpha-methylacyl-coenzyme A racemase, ART-4, ARTC1/m, B7H4, BAGE-1, BCL-2, bcr/abl, beta-catenin/m, BING-4, BRCA1/m, BRCA2/m, CA 15-3/CA 27-29, CA 19-9, CA72-4, CA125, calreticulin, CAMEL, CASP-8/m, cathepsin B, cathepsin L, CD1, CD20, CD22, CD25, CDE30, CD33, CD4, CD52, CD55, CD56, CD80, CDCl27/m, CDK4/m, CDKN2A/m, CEA, CLCA2, CML28, CML66, COA-1/m, coactosin-like protein, collage XXIII, COX-2, CT-9/BRD6, Cten, cyclin B1, cyclin D1, cyp-B, CYPB1, DAM-10, DAM-6, DEK-CAN, EFTUD2/m, EGFR, ELF2/m, EMMPRIN, EpCam, EphA2, EphA3, ErbB3, ETV6-AML1, EZH2, FGF-5, FN, Frau-1, G250, GAGE-1, GAGE-2, GAGE-3, GAGE-4, GAGE-5, GAGE-6, GAGE7b, GAGE-8, GDEP, GnT-V, gpl OO, GPC3, GPNMB/m, HAGE, HAST-2, hepsin, Her2/neu, HERV-K-MEL, HLA-A*0201-R1 71, HLA-A1 1/m, HLA-A2/m, HNE, homeobox NKX3.1, HOM-TES-14/SCP-1, HOM-TES-85, HPV-E6, HPV-E7, HSP70-2M, HST-2, hTERT, iCE, IGF-1R, IL-13Ra2, IL-2R, IL-5, immature laminin receptor, kallikrein-2, kallikrein-4, Ki67, KIAA0205, KIAA0205/m, KK-LC-1, K-Ras/m, LAGE-A1, LDLR-FUT, MAGE-A1, MAGE-A2, MAGE-A3, MAGE-A4, MAGE-A6, MAGE-A9, MAGE-A10, MAGE-A12, MAGE-B1, MAGE-B2, MAGE-B3, MAGE-B4, MAGE-B5, MAGE-B6, MAGE-B10, MAGE-B16, MAGE-B17, MAGE-C1, MAGE-C2, MAGE-C3, MAGE-D1, MAGE-D2, MAGE-D4, MAGE-El, MAGE-E2, MAGE-F1, MAGE-H1, MAGEL2, mammaglobin A, MART-1/melan-A, MART-2, MART-2/m, matrix protein 22, MC1R, M-CSF, MEI/m, mesothelin, MG50/PXDN, MMP1 1, MN/CA IX-antigen, MRP-3, MUC-1, MUC-2, MUM-1/m, MUM-2/m, MUM-3/m, myosin class l/m, NA88-A, N-acetylglucosaminyltransferase-V, Neo-PAP, Neo-PAP/m, NFYC/m, NGEP, NMP22, NPM/ALK, N-Ras/m, NSE, NY-ESO-B, NY-ESO-1, OA1, OFA-iLRP, OGT, OGT/m, OS-9, OS-9/m, osteocalcin, osteopontin, pi 5, p190 minor bcr-abl, p53, p53/m, PAGE-4, PAI-1, PAI-2, PAP, PART-1, PATE, PDEF, Pim-1-Kinase, Pin-1, Pml/PARalpha, POTE, PRAME, PRDXS/m, prostein, proteinase-3, PSA, PSCA, PSGR, PSM, PSMA, PTPRK m, RAGE-1, RBAF600/m, RHAMM/CD1 68, RU1, RU2, S-100, SAGE, SART-1, SART-2, SART-3, SCC, SIRT2/m, Sp17, SSX-1, SSX-2/HOM-MEL-40, SSX-4, STAMP-1, STEAP-1, survivin, survivin-2B, SYT-SSX-1, SYT-SSX-2, TA-90, TAG-72, TARP, TEL-AML1, TGFbeta, TGFbetaRII, TGM-4, TPI/m, TRAG-3, TRG, TRP-1, TRP-2/6b, TRP/INT2, TRP-p8, tyrosinase, UPA, VEGFR1, VEGFR-2/FLK-1, and WT1.

In another particularly preferred embodiment, the RNA (species) used herein, preferably the original RNA (species) that is to be adapted or the adapted RNA (species), comprises at least one coding region comprising or consisting of a nucleic acid sequence encoding at least one therapeutic peptide or protein which can be used inter alia in the treatment of e.g. metabolic or endocrine disorders. These and other proteins are understood to be therapeutic, as they are meant to treat the subject by replacing its defective endogenous production of a functional protein in sufficient amounts. Accordingly, such therapeutic proteins are typically mammalian, in particular human proteins.

Preferably, the therapeutic peptide or protein is selected from or derived from any therapeutic peptide or protein which is used or can be used for medical treatment (e.g. protein replacement), antibodies, T cell receptors, gene-editing proteins (e.g. Cas9).

In another particularly preferred embodiment, the RNA (species) as used herein, preferably the original RNA (species) that is to be adapted or the adapted RNA (species), encodes at least one therapeutic antibody selected from the group consisting of antibodies which are used inter alia for the treatment of cancer or tumor diseases, immune disorders, infectious diseases, Alzheimer's disease, asthma, and antibodies which are used for the treatment of diverse disorders, e.g. osteoporosis, tooth decay, idiopathic pulmonary fibrosis, focal segmental glomerulosclerosis, pain, muscular dystrophy, and Neovascular age-related macular degeneration.

In another particularly preferred embodiment the RNA (species) used herein, preferably the original RNA (species) that is to be adapted or the adapted RNA (species), comprises at least one coding region comprising or consisting of a nucleic acid sequence encoding at least one allergen associated with allergy or an allergic disease (allergens or allergenic antigens) and/or at least one autoimmune self-antigens (autoantigens).

Adapted RNA and Vectors:

In a further aspect, the present invention relates to the RNA that is obtainable by the methods according to the invention. More specifically, the invention provides an adapted RNA (or an RNA (species) with an adapted sequence, respectively), which is obtainable by the method for modifying the retention time of an RNA on a chromatographic column, by the method for purifying at least one RNA species from a mixture of at least two RNA species, by the method for co-purifying at least two RNA species from a mixture comprising at least two RNA species, by the method for harmonizing the numbers of A and/or U nucleotides in the sequences of at least two RNA species, or by the method for providing an adapted RNA as described herein.

The (adapted) RNA according to the invention is preferably characterized in that its sequence was adapted by altering the number of A and/or U nucleotides with respect to the number of A and/or U nucleotides in the original RNA sequence. The original RNA sequence is preferably an RNA sequence as described herein, preferably the corresponding wild-type RNA sequence, more preferably a corresponding RNA sequence that was modified as described herein, e.g. G/C content modified or codon optimized.

In preferred embodiments, the adapted RNA according to the invention is characterized by any one of the features described herein, in particular with respect to the inventive methods.

In certain embodiments, the adapted RNA according to the invention is characterized by a ratio of the number of A nucleotides to the number of U nucleotides in the RNA sequence, which is in the range from 0.2 to 5, preferably from 0.5 to 3, more preferably from 1 to 3, even more preferably from 1 to 2.5, even more preferably from 1.2 to 2, even more preferably from 1.4 to 2, even more preferably from 1.5 to 2, most preferably from 1.6 to 2.

According to a particularly preferred embodiment, the RNA according to the invention comprises at least one coding region comprising or consisting of a nucleic acid sequence according to any one of SEQ ID NO: 26 to 14079, 14080 to 16264, 16265 to 28640, 28641 to 30568, or a fragment or variant of any one of these nucleic acid sequences.

In a further aspect, the present invention concerns a vector comprising the adapted RNA sequence according to the invention. In preferred embodiments, the vector according to the invention is a DNA vector comprising a nucleic acid sequence corresponding to the adapted RNA sequence according to the invention, or a fragment or variant thereof. Alternatively, the vector according to the invention is a DNA vector comprising a nucleic acid sequence encoding the adapted RNA sequence according to the invention, or a fragment or variant thereof. Preferably, the vector according to the invention is a plasmid vector or a viral vector.

RNA Production

The RNA according to the present invention may be prepared using any method known in the art, including synthetic methods such as e.g. solid phase RNA synthesis, as well as in vitro methods, such as RNA in vitro transcription reactions. Particularly preferred is RNA in vitro transcription.

The terms "RNA in vitro transcription" or "in vitro transcription" relate to a process, wherein RNA is synthesized in a cell-free system (in vitro). DNA, particularly plasmid DNA (or PCR product), is typically used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase. Particular examples of DNA-dependent RNA polymerases are the T7, T3, and SP6 RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, for example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Reagents used in RNA in vitro transcription typically include: a DNA template (linearized plasmid DNA or PCR product) with a promoter sequence that has a high binding affinity for its respective RNA polymerase such as bacteriophage-encoded RNA polymerases (T7, T3, SP6, or Syn5); ribonucleoside triphosphates (NTPs) for the four bases (adenine, cytosine, guanine and uracil); optionally, a cap analogue as defined herein (e.g. m7G(5')ppp(5')G (m7G)); optionally, further modified nucleotides as defined herein; a DNA-dependent RNA polymerase capable of binding to the promoter sequence within the DNA template (e.g. T7, T3, SP6, or Syn5 RNA polymerase); optionally, a ribonuclease (RNase) inhibitor to inactivate any contaminating RNase; optionally, a pyrophosphatase to degrade pyrophosphate, which may inhibit transcription; MgCl2, which supplies Mg2+ ions as a co-factor for the polymerase; a buffer (Tris or HEPES) to maintain a suitable pH value, which can also contain antioxidants (e.g. DTT), and/or polyamines such as spermidine at optimal concentrations, or a buffer system as disclosed in WO2017/109161.

In embodiments, the nucleotide mixture used in RNA in vitro transcription may additionally contain modified nucleotides as defined herein. In embodiments, the nucleotide mixture (i.e. the fraction of each nucleotide in the mixture) may be optimized for the given RNA sequence, preferably as described WO2015/188933.

In embodiment where more than one different RNA as defined herein has to be produced, e.g. where 2, 3, 4, 5, 6, 7, 8, 9, 10 or even more different RNA molecules have to be produced, procedures as described in WO2017/109134 may be suitably used.

In a preferred embodiment, RNA production is performed under current good manufacturing practice (GMP), implementing various quality control steps on DNA and RNA level, according to WO2016/180430. The obtained RNA products are preferably purified using PureMessenger® (CureVac, TUbingen, Germany; RP-HPLC according to WO2008/077592) and/or tangential flow filtration (as described in WO2016/193206). In a preferred embodiment, the RNA, particularly the purified RNA is lyophilized according to WO2016/165831 or WO2011/069586 to yield a temperature stable RNA as defined herein. The RNA of the invention, particularly the purified RNA may also be lyophilized using spray-drying or spray-freeze drying according to WO2016/184575 or WO2016184576 to yield a temperature stable RNA as defined herein.

Method for Providing an Adapted RNA Sequence

According to a further aspect, the invention also provides a method for providing an adapted RNA sequence, wherein the method preferably comprises the steps of
a) optionally, determining the total number of nucleotides in an original RNA sequence;
b) determining the number of A and/or U nucleotides in the original RNA sequence;
c) determining the codons in the original RNA sequence that can be replaced with at least one alternative codon without changing the encoded amino acid sequence; and
d) adjusting the number of A and/or U nucleotides in the RNA sequence to a pre-set number of A and/or U nucleotides by replacing at least one original codon with an alternative codon, wherein the alternative codon encodes the same amino acid as the original codon and is further characterized in a higher content of A and/or U nucleotides.

In preferred embodiments, step b) of the method further comprises determining the number of G and/or C nucleotides in the original RNA sequence.

Preferably, the method for providing an adapted RNA according to the invention further comprises a step e) which comprises producing the RNA. Preferably, the RNA is produced by any suitable method known in the art or by a method as described herein under the section 'RNA production'. More preferably, the method involves a step of in vitro transcription, preferably as described herein. In a particularly preferred embodiment, the method involves in vitro transcription and a step of purifying the obtained RNA in a chromatographic process, preferably an HPLC process, more preferably an RP-HPLC process, preferably as described herein.

In the following, the concept of the inventive method for providing an adapted RNA is further illustrated by describing a preferred embodiment (see also Example 6 herein). The basic principle of sequence adaptation, particularly of AU adaptation by changing the codon usage, is exemplarily also illustrated in FIG. 2.

An automated in silico method (algorithm) may be used to set the number of any nucleotide in an RNA sequence to a defined value, without altering the amino acid sequence (step d) of the method). In the context of the invention, the automated in silico method may used for sequence adaptation, in particular adaptation of the number of A and/or U nucleotides (AU count)) of RNA sequences in order to allow harmonization of RNA mixtures for HPLC co-analysis and/or HPLC co-purification.

Table 1 below summarizes the codon changes (for each genetically encoded amino acid) in the coding sequence that may be applied to increase the number of A and/or U nucleotides of an RNA sequence, without changing the encoded amino acid sequence. Table 2 summarizes the codon changes (for each genetically encoded amino acid) in the coding sequence that may be applied to decrease the number of A and/or U nucleotides of an RNA sequence, without changing the encoded amino acid sequence.

TABLE 1

Codon changes that allow for increase in the number of A and/or U nucleotides

| Amino acid | codon | Codon for AU increase | Change in AU count |
|---|---|---|---|
| Ala | GCG | GCA/GCU | +1 |
| Ala | GCA | n.a. | |
| Ala | GCU | n.a. | |
| Ala | GCC | GCA/GCU | +1 |
| Cys | UGU | n.a. | |
| Cys | UGC | UGU | +1 |
| Asp | GAU | n.a. | |
| Asp | GAC | GAU | +1 |
| Glu | GAG | GAA | +1 |
| Glu | GAA | n.a. | |
| Phe | UUU | n.a. | |
| Phe | UUC | UUU | +1 |
| Gly | GGG | GGA/GGU | +1 |
| Gly | GGA | n.a. | |
| Gly | GGU | n.a. | |
| Gly | GGC | GGA/GGU | +1 |
| His | CAU | n.a. | |
| His | CAC | CAU | +1 |
| Ile | AUA | n.a. | |
| Ile | AUU | n.a. | |
| Ile | AUC | AUA/AUU | +1 |
| Lys | AAG | AAA | +1 |
| Lys | AAA | n.a. | |
| Leu | UUG | UUA | +1 |
| Leu | UUA | n.a. | |
| Leu | CUG | UUG/CUA/CUU | +1 |
| Leu | CUG | UUA | +2 |
| Leu | CUA | UUA | +1 |
| Leu | CUU | UUA | +1 |
| Leu | CUC | UUG/CUA/CUU | +1 |
| Leu | CUC | UUA | +2 |
| Met | AUG | n.a. | |
| Asn | AAU | n.a. | |
| Asn | AAC | n.a. | |
| Pro | CCG | CCU/CCA | +1 |
| Pro | CCA | n.a. | |
| Pro | CCU | n.a. | |
| Pro | CCC | CCU/CCA | +1 |
| Gln | CAG | CAA | +1 |
| Gln | CAA | n.a. | |
| Arg | AGG | AGA | +1 |
| Arg | AGA | n.a. | |
| Arg | CGG | CGU/CGA | +1 |
| Arg | CGG | AGA | +2 |
| Arg | CGA | AGA | +1 |
| Arg | CGU | AGA | +1 |
| Arg | CGC | CGU/CGA | +1 |
| Arg | CGC | AGA | +2 |
| Ser | AGU | n.a. | |
| Ser | AGC | AGU/UCA/UCU | +1 |
| Ser | UCG | AGU/UCA/UCU | +1 |
| Ser | UCA | n.a. | |
| Ser | UCU | n.a. | |
| Ser | UCC | AGU/UCA/UCU | +1 |
| Thr | ACG | ACA/ACU | +1 |
| Thr | ACA | n.a. | |
| Thr | ACU | n.a. | |
| Thr | ACC | ACA/ACU | +1 |
| Val | GUG | GUA/GUU | +1 |
| Val | GUA | n.a. | |
| Val | GUU | n.a. | |
| Val | GUC | GUA/GUU | +1 |
| Trp | UGG | n.a. | |
| Tyr | UAU | n.a. | |
| Tyr | UAC | UAU | +1 |
| Stop | UGA* | UAA | +1 |
| Stop | UAG | UAA | +1 |
| Stop | UAA | n.a. | — | n.a. = not applicable

TABLE 2

Codon changes that allow for decrease in the number of A and/or U nucleotides

| Amino acid | codon | Codon for AU increase | Change in AU count |
|---|---|---|---|
| Ala | GCG | n.a. | |
| Ala | GCA | GCG/GCC | −1 |
| Ala | GCU | GCG/GCC | −1 |
| Ala | GCC | n.a. | |
| Cys | UGU | UGC | −1 |
| Cys | UGC | n.a. | |
| Asp | GAU | GAC | −1 |
| Asp | GAC | n.a. | |
| Glu | GAG | n.a. | |
| Glu | GAA | GAG | −1 |
| Phe | UUU | UUC | −1 |
| Phe | UUC | n.a. | |
| Gly | GGG | n.a. | |
| Gly | GGA | GGG/GGC | −1 |
| Gly | GGU | GGG/GGC | −1 |
| Gly | GGC | n.a. | |
| His | CAU | CAC | −1 |
| His | CAC | n.a. | |
| Ile | AUA | AUC | −1 |
| Ile | AUU | AUC | −1 |
| Ile | AUC | n.a. | |
| Lys | AAG | n.a. | |
| Lys | AAA | AAG | −1 |
| Leu | UUG | CUG/CUC | −1 |
| Leu | UUA | UUG/CUA/CUU | −1 |
| Leu | UUA | CUG/CUC | −2 |
| Leu | CUG | n.a. | |
| Leu | CUA | CUG/CUC | −1 |
| Leu | CUU | CUG/CUC | −1 |
| Leu | CUC | n.a. | |
| Met | AUG | n.a. | |
| Asn | AAU | n.a. | |
| Asn | AAC | n.a. | |
| Pro | CCG | CCC | −1 |
| Pro | CCA | CCG | −1 |
| Pro | CCU | CCG | −1 |
| Pro | CCA | CCC | −2 |
| Pro | CCU | CCC | −2 |
| Pro | CCC | n.a. | |
| Gln | CAG | n.a. | |
| Gln | CAA | CAG | −1 |
| Arg | AGG | CGC/CGG | −1 |
| Arg | AGA | AGG/CGA/CGU | −1 |
| Arg | AGA | CGC/CGG | −2 |
| Arg | CGG | n.a. | |
| Arg | CGA | CGC/CGG | −1 |
| Arg | CGU | CGC/CGG | −1 |
| Arg | CGC | n.a. | |
| Ser | AGU | n.a. | |
| Ser | AGC | n.a. | |
| Ser | UCG | n.a. | |
| Ser | UCA | UCG/AGC | −1 |
| Ser | UCU | UCG/AGC | −1 |
| Ser | UCC | n.a. | |
| Thr | ACG | n.a. | |
| Thr | ACA | ACG/ACC | −1 |
| Thr | ACU | ACG/ACC | −1 |
| Thr | ACC | n.a. | |
| Val | GUG | n.a. | |
| Val | GUA | GUG/GUC | −1 |
| Val | GUU | GUG/GUC | −1 |
| Val | GUC | n.a. | |
| Trp | UGG | n.a. | |
| Tyr | UAU | UAC | −1 |
| Tyr | UAC | n.a. | |
| Stop | UGA | n.a. | |
| Stop | UAG | n.a. | |
| Stop | UAA | UGA/UAG | −1 | n.a. = not applicable

In the initial phase of the method, a matrix for each codon comprised in the RNA sequence to be adapted is preferably created, identifying possible codon exchanges, which do not result in a change of the encoded amino acid (herein referred to as "exchange matrix"). An exemplary "exchange matrix" is shown in Formula (I).

$$\left.\begin{array}{cc} A & 1 \\ C & 1 \\ G & 1 \\ T & 1 \\ * & 4 \end{array}\right\} CGA \quad \text{Formula (I)}$$

Formula (I) shows that for codon "CGA" a change to an alternative codon offers the option of increasing the number of A nucleotides by 1 (e.g.: CGA→AGA), offers the option of increasing the number of C nucleotides by 1 (e.g. CGA→CGC), offers the option of increasing the number of G nucleotides by 1 (e.g. CGA→CGG), and offers the option of increasing the number of T nucleotides by 1 (e.g. CGA→CGT).

Exchange matrices are preferably generated for each individual codon in the RNA sequence to be adapted. Using said exchange matrices, the potential maximum number of the respective nucleotides (A and T(U) count, respectively) in each codon may be determined (without changing the amino acid sequence). Accordingly, all codons of the sequence, which is to be adapted, are analyzed with respect to potential codon exchanges by step-wise iteration, wherein in each iteration step the corresponding codon is analysed using the respective exchange matrix (as outlined above) for potential nucleotide changes. For example, if no changes are theoretically possible in the respective codon, e.g. as in the case of "ATG" or "TGG", the corresponding exchange matrix as exemplarily shown in Formula (II) was used (* of exchange matrix=0).

$$\left.\begin{array}{cc} A & 0 \\ C & 0 \\ G & 0 \\ T & 0 \\ * & 0 \end{array}\right\} ATG \quad \text{Formula (II)}$$

Formula (II) shows that for codon "ATG" a change to an alternative codon offers no option of increasing the number of A nucleotides, C nucleotides, G nucleotides or T nucleotides (as there are no alternative codons for ATG (Met)).

In cases where exchanges according to the respective exchange matrix (*>0) are theoretically possible, the codon is further analysed if the change can be implemented under the premise that e.g. only codons that offer the option of increasing the number of A and/or T(U) nucleotides are adapted. Therefore the intersection between the target nucleotides (e.g. A and/or T(U)) and the nucleotides that potentially generate a positive result (that is, A and/or T(U) change; see e.g. Formula (I)) in the current exchange matrix are constructed. As a result, each codon may be categorized and grouped into one of three categories:

Category 1 (Category "Favourable"):

Potential codon exchanges allowing an increase in only one target nucleotide (in the present example A or T(U)). For example, the codon "GAC" (Asp) can be changed to "GAU" (Asp) in order to increase the number of A and T(U) nucleotides. No further analysis is required since that modification does not have any further impact (besides the one mentioned above) on the number of A and T(U) nucleotides.

Category 2 (Category "Possible"):

Potential codon exchanges allowing the increase in both target nucleotides (in the present example A and T(U)). For example, codon "GCA" can be changed to "GCU", which would increase the T(U) count but at the same time decrease the A count. Accordingly, further analysis would be required with respect to codons belonging to this the category in order to decide, whether the number of one of the two target nucleotides (T(U)) in this example should be increased at the expense of a reduction of the number of the other target nucleotide (A).

Category 3 (Category "Impossible"):

Codons in the RNA sequence, for which no alternative codons exist (*=0). Examples for this category 3 are ATG (Met; start codon) or "UGG" (Trp).

All codons of the original sequence are preferably categorized in that manner. It may then preferably be calculated how many potential nucleotide exchanges have been identified for all target nucleotides (A, T(U)).

In preferred embodiments, the method comprises adapting the RNA sequence using only codons from category 1 as defined herein. In some embodiments, codons from category 2 may also be used (for example, as soon as all codons from category 1 have been used), thus offering additional adaptation possibilities for A and T(U) counts. If category 2 is required in order to achieve the desired nucleotide counts, calculation of the following ratio may be used for identifying the exchange nucleotide (nucleotide A or T(U)):

$$\frac{c_i}{x_i - p_i}$$

wherein i represents the corresponding target, $c_i$ is the count of possible adaptation positions of i in category 2, $x_i$ is the desired threshold for i, $p_i$ the count for the already changed identified adaptation positions. All calculated ratios are preferably ranked and starting from lowest to highest ratio, the changes from category 2 are applied, until the desired threshold has been reached or until all the possible exchanges from category 2 have been performed. This procedure is preferably carried out iteratively for any RNA sequence, where the target nucleotide count, e.g. the target number of A and/or U nucleotides, cannot be achieved by only using exchanges according to category 1.

In cases where the desired target nucleotide count cannot be achieved (as all alternative codons from category 1 and 2 have been used, which means that no further changes are possible), an adapted sequence is preferably generated that is matching the target nucleotide count as close as possible.

According to some embodiments of the method, one of the following improvements may be implemented therein:

1. Besides the basic equal distribution, which is used in the embodiment described above and which is based on the exchange possibilities, other distribution models may also be envisaged, such as normal distributed, first occurrences distribution, last occurrences distribution or random-based distribution. Alternatively, the mean of the possible changes or median of the possible changes may be determined and all exchanges may be arranged around these values.
2. The exchange matrix may further contain additional information about the codon for the target sequence (e.g. codon usage etc.). This creates a further criteria for the question of whether a codon exchange is desirable or not, facilitating adaptation to a specific codon usage or a different nucleotide ratio in the target sequence.
3. A third category may further be implemented by sequences or motifs, which should be avoided by an exchange (e.g. a recognition motif of a restriction enzyme, promotor sequences or sequences building not desired secondary structures, etc.).
4. Automated binning of input sequences may be performed, based on their length and the occurrence of the desired target nucleotides in order to identify optimal nucleotide counts for A and/or U adaptation.

Any one of the steps or combination of steps described with respect to the method for providing an adapted RNA according to the invention may preferably be applied to the other methods described herein, in particular to the method for modifying the retention time of an RNA on a chromatographic column, to the method for purifying at least one RNA species from a mixture of at least two RNA species, to the method for co-purifying at least two RNA species from a mixture comprising at least two RNA species, or to the method for harmonizing the numbers of A and/or U nucleotides in the sequences of at least two RNA species.

Composition and Vaccine

In a further aspect, the present invention provides a composition comprising at least one adapted RNA sequence as described herein and, optionally, a pharmaceutically acceptable carrier. The inventive composition comprising the at least one adapted RNA as described herein is preferably a pharmaceutical composition or a vaccine as described herein. According to a preferred embodiment, the inventive composition is a polyvalent vaccine, preferably as described herein.

In preferred embodiments, the composition according to the invention comprises an RNA obtainable by a method as described herein, in particular by the method for modifying the retention time of an RNA on a chromatographic column, the method for purifying at least one RNA species from a mixture of at least two RNA species, the method for co-purifying at least two RNA species from a mixture comprising at least two RNA species, the method for harmonizing the numbers of A and/or U nucleotides in the sequences of at least two RNA species, or the method for providing an adapted RNA as described herein.

According to a preferred embodiment, the composition according to the invention comprises at least two RNA species, wherein the sequence of at least one RNA species is adapted by altering the number of A and/or U nucleotides in the sequence of the at least one RNA species with respect to the number of A and/or U nucleotides in the original RNA sequence. More preferably, the composition comprises at least two RNA species, wherein at least one RNA species is an adapted RNA as obtained by any one of the methods according to the invention, preferably by the method for modifying the retention time of an RNA on a chromatographic column, the method for purifying at least one RNA species from a mixture of at least two RNA species, the method for co-purifying at least two RNA species from a mixture comprising at least two RNA species, the method for harmonizing the numbers of A and/or U nucleotides in the sequences of at least two RNA species, or the method for providing an adapted RNA as described herein. More preferably, the numbers of A and/or U nucleotides in the sequences of the at least two RNA species comprised in the inventive composition are harmonized as described herein.

In preferred embodiments, the composition according to the invention comprises at least two RNA species, e.g., at least 3, at least 4, at least 5, at least 6, at least 7, at least 8, at least 9, or at least 10 RNA species, wherein the sequence of at least one RNA species is adapted by altering the number of A and/or U nucleotides in the sequence of the at least one RNA species with respect to the number of A and/or U nucleotides in the original RNA sequence, wherein the numbers of A and/or U nucleotides in the two (or more) RNA species preferably differ from each other by not more than 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 110, 120, 130, 140, 150. In preferred embodiments, the numbers of A and/or U nucleotides in the RNA species preferably differ from each other by not more than 2, more preferably by not more than 3, even more preferably by not more than 4, even more preferably by not more than 5, most preferably by not more than 6. In a further preferred embodiment, the numbers of A and/or U nucleotides in the RNA species differ from each other by not more than 10, preferably by not more than 20, more preferably by not more than 30, even more preferably by not more than 40, most preferably by not more than 50. It is particularly preferred, that the numbers of A and/or U nucleotides in the two or more RNA species are identical.

Preferably, the inventive composition comprises or consists of at least one adapted RNA (species) as described herein and a pharmaceutically acceptable carrier. The expression "pharmaceutically acceptable carrier" as used herein preferably includes the liquid or non-liquid basis of the inventive composition, which is preferably a pharmaceutical composition or a vaccine. If the inventive composition is provided in liquid form, the carrier will preferably be water, typically pyrogen-free water; isotonic saline or buffered (aqueous) solutions, e.g. phosphate, citrate etc. buffered solutions. Water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer.

Furthermore, one or more compatible solid or liquid fillers or diluents or encapsulating compounds may be used as well, which are suitable for administration to a person. The term "compatible" as used herein means that the constituents of the inventive composition are capable of being mixed with the at least one (adapted) RNA (species) of the composition, in such a manner that no interaction occurs, which would substantially reduce the biological activity or the pharmaceutical effectiveness of the inventive composition under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from *Theobroma*; polyols, such as, for example, polypropylene glycol, glycerol, sorbitol, mannitol and polyethylene glycol; alginic acid.

Further additives, which may be included in the composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

In a preferred embodiment the (adapted) RNA as defined herein, comprised in the composition, the pharmaceutical composition, the vaccine as defined herein, is complexed or at least partially complexed or associated with one or more cationic or polycationic compound preferably with cationic or polycationic polymer, cationic or polycationic polysaccharide, cationic or polycationic lipid, cationic or polycationic protein, cationic or polycationic peptide, or any combinations thereof.

The term "cationic or polycationic compound" as used herein will be recognized and understood by the person of ordinary skill in the art, and are for example intended to refer to a charged molecule, which is positively charged at a pH value ranging from about 1 to 9, at a pH value ranging from about 3 to 8, at a pH value ranging from about 4 to 8, at a pH value ranging from about 5 to 8, more preferably at a pH value ranging from about 6 to 8, even more preferably at a pH value ranging from about 7 to 8, most preferably at a physiological pH, e.g. ranging from about 7.2 to about 7.5. Accordingly, a cationic component, e.g. a cationic peptide, cationic protein, cationic polymer, cationic polysaccharide, cationic lipid may be any positively charged compound or polymer which is positively charged under physiological conditions. A "cationic or polycationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the given conditions.

Cationic or polycationic compounds, being particularly preferred in this context may be selected from the following list of cationic or polycationic peptides or proteins of fragments thereof: protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides, pAntp, pIsl, FGF, Lactoferrin, Transportan, Buforin-2, Bac715-24, SynB, SynB(1), pVEC, hCT-derived peptides, SAP, or histones. More preferably, the nucleic acid as defined herein, preferably the mRNA as defined herein, is complexed with one or more polycations, preferably with protamine or oligofectamine, most preferably with protamine. In this context protamine is particularly preferred.

Further preferred cationic or polycationic compounds, which can be used as transfection or complexation agent may include cationic polysaccharides, for example chitosan, polybrene etc.; cationic lipids, e.g. DOTMA, DMRIE, di-C14-amidine, DOTIM, SAINT, DC-Chol, BGTC, CTAP, DOPC, DODAP, DOPE: Dioleyl phosphatidylethanolamine, DOSPA, DODAB, DOIC, DMEPC, DOGS, DIMRI, DOTAP, DC-6-14, CLIP1, CLIP6, CLIP9, oligofectamine; or cationic or polycationic polymers, e.g. modified polyaminoacids, such as beta-aminoacid-polymers or reversed polyamides, etc., modified polyethylenes, such as PVP etc., modified acrylates, such as pDMAEMA etc., modified amidoamines such as pAMAM etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI, poly(propyleneimine), etc., polyallylamine, sugar backbone based polymers, such as cyclodextrin based polymers, dextran based polymers, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

In embodiments, the composition or vaccine comprises at least one (adapted)RNA as described herein, which is complexed with one or more polycationic compounds and/or a polymeric carrier, and at least one free RNA, wherein the at least one complexed RNA is preferably identical to the at least one RNA according to the present invention.

The term "polymeric carrier" as used herein will be recognized and understood by the person of ordinary skill in the art, and are for example intended to refer to a compound that facilitates transport and/or complexation of another compound (cargo). A polymeric carrier is typically a carrier that is formed of a polymer. A polymeric carrier may be associated to its cargo (nucleic acid, RNA) by covalent or non-covalent interaction In this context it is particularly preferred that the at least one RNA of the inventive composition is complexed at least partially with a cationic or polycationic compound and/or a polymeric carrier, preferably cationic proteins or peptides. In this context, the disclosure of WO2010/037539 and WO2012/113513 is incorporated herewith by reference. Partially means that only a part of the artificial nucleic acid is complexed with a cationic compound and that the rest of the artificial nucleic acid is (comprised in the inventive pharmaceutical composition, immunogenic composition) in uncomplexed form ("free").

Further preferred cationic or polycationic proteins or peptides may be derived from formula (Arg)l;(Lys)m;(His)n;(Orn)o;(Xaa)x of the patent application WO2009/030481, the disclosure of WO2009/030481 relating thereto incorporated herewith by reference.

According to a preferred embodiment, the composition of the present invention comprises the RNA as defined herein, and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein.

In this context, polymeric carriers according to formula {(Arg)l;(Lys)m;(His)n;(Orn)o;(Xaa)x(Cys)y} and formula Cys,{(Arg)l;(Lys)m;(His)n;(Orn)o;(Xaa)x}Cys$_2$ of the patent application WO2012/013326 are preferred, the disclosure of WO2012/013326 relating thereto incorporated herewith by reference.

In a further particular embodiment, the polymeric carrier which may be used to complex the RNA as defined herein or any further nucleic acid comprised in the (pharmaceutical) composition or vaccine according to the invention may be derived from a polymeric carrier molecule according formula (L-P$^1$-S-[S-P$^2$-S]$_n$-S-P$^3$-L) of the patent application WO2011/026641, the disclosure of WO2011/026641 relating thereto incorporated herewith by reference.

In other embodiments, the composition, which is preferably a composition, a pharmaceutical composition or a vaccine, comprises at least one artificial nucleic acid as described herein, wherein the at least one artificial nucleic acid is complexed or associated with polymeric carriers and, optionally, with at least one lipid component as described in the PCT applications PCT/EP2016/06322, PCT/EP2016/063227, PCT/EP2016/063229, PCT/EP2016/063226. In this context, the disclosures of PCT/EP2016/06322, PCT/EP2016/063227, PCT/EP2016/063229, PCT/EP2016/063226 is herewith incorporated by reference.

In preferred embodiments, the polymeric carrier compound is formed by, or comprises or consists of the peptide elements CysArg12Cys or CysArg12 or TrpArg12Cys. In particularly preferred embodiments, the polymeric carrier compound consists of a $(R_{12}C)$—$(R_{12}C)$ dimer, a $(WR_{12}C)$—$(WR_{12}C)$ dimer, or a $(CR_{12})$—$(CR_{12}C)$—$(CR_{12})$ trimer, wherein the individual peptide elements in the dimer (e.g. (WR12C)), or the trimer (e.g. (CR12)), are connected via —SH groups.

In embodiments, where the complexed (adapted) RNA is complexed with cationic or polycationic peptides or proteins as the carrier compound, the nitrogen/phosphate ratio of the complexed RNA ranges from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the nucleic acid, preferably the RNA.

Accordingly, the composition as defined herein, comprising at least one RNA as defined herein, wherein the N/P ratio of the at least one artificial nucleic acid, preferably the RNA as defined herein, to the one or more cationic or polycationic compound as defined herein, preferably protamine, is in the range of about 0.1 to 20, including a range of about 0.3 to 4, of about 0.5 to 2, of about 0.7 to 2 and of about 0.7 to 1.5.

Suitably, the at least one RNA as defined herein, is complexed with one or more cationic or polycationic compounds as defined herein, in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of nucleic acid to cationic or polycationic compound and/or with a polymeric carrier; or optionally in a nitrogen/phosphate ratio of nucleic acid to cationic or polycationic component and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9.

In this context it is particularly preferred that the at least one RNA as defined herein is complexed with protamine.

Suitably, the complexed RNA is complexed with protamine by addition of protamine-trehalose solution to the RNA sample at an RNA to protamine weight to weight ratio (w/w) of 2:1.

In preferred embodiments, the composition, the pharmaceutical composition, the vaccine as defined herein comprises the at least one RNA as defined herein which is complexed with one or more cationic or polycationic compounds (e.g. protamine), and at least one free RNA.

In preferred embodiments, the at least one complexed RNA (e.g. protamine complexed RNA) is identical to the at least one free RNA.

Preferably, the molar ratio of the RNA of the adjuvant component (e.g. protamine-complexed RNA) to the free nucleic acid, particularly the free RNA may be selected from a molar ratio of about 0.001:1 to about 1:0.001, including a ratio of about 1:1.

Preferably the ratio of complexed RNA of the adjuvant component (e.g. protamine-complexed RNA), to free nucleic acid, particularly the free RNA, may be selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), wherein the ratio is most preferably about 1:1 (w/w).

With respect to a composition comprising an adjuvant component (e.g. protamine-complexed RNA) and a free RNA component as defined herein, the disclosure of WO2009/144230 is incorporated herewith by reference. Such a composition comprising an adjuvant component as defined herein (e.g. protamine complexed RNA) and a free RNA component as defined herein may be generated using means and methods as disclosed in WO2016/165825.

In preferred embodiments, the composition, which is preferably a pharmaceutical composition, a vaccine, comprises at least one (adapted)RNA as described herein, wherein the at least one RNA is complexed or associated with one or more lipids (e.g. cationic lipids and/or neutral lipids), thereby forming liposomes, lipid nanoparticles (LNPs), lipoplexes, and/or nanoliposomes.

In the context of the present invention, the term "lipid nanoparticle", also referred to as "LNP", is not restricted to any particular morphology, and include any morphology generated when a cationic lipid and optionally one or more further lipids are combined, e.g. in an aqueous environment and/or in the presence of an RNA. For example, a liposome, a lipid complex, a lipoplex and the like are within the scope of a lipid nanoparticle (LNP).

LNPs typically comprise a cationic lipid and one or more excipient selected from neutral lipids, charged lipids, steroids and polymer conjugated lipids (e.g. PEGylated lipid). The RNA may be encapsulated in the lipid portion of the LNP or an aqueous space enveloped by some or the entire lipid portion of the LNP. The RNA or a portion thereof may also be associated and complexed with the LNP. An LNP may comprise any lipid capable of forming a particle to which the nucleic acids are attached, or in which the one or more nucleic acids are encapsulated. Preferably, the LNP comprising nucleic acids comprises one or more cationic lipids, and one or more stabilizing lipids. Stabilizing lipids include neutral lipids and PEGylated lipids.

In one embodiment, the LNP consists essentially of (i) at least one cationic lipid; (ii) a neutral lipid; (iii) a sterol, e.g., cholesterol; and (iv) a PEG-lipid, e.g. PEG-DMG or PEG-cDMA, in a molar ratio of about 20-60% cationic lipid:5-25% neutral lipid:25-55% sterol; 0.5-15% PEG-lipid.

In that context, a preferred sterol is cholesterol. The sterol can be about 10 mol % to about 60 mol % or about 25 mol to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the LNPs include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

The cationic lipid of an LNP may be cationisable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

The LNP may comprise any further cationic or cationisable lipid, i.e. any of a number of lipid species which carry a net positive charge at a selective pH, such as physiological pH.

Such lipids include, but are not limited to, N,N-dioleyl-N,N-dimethylammonium chloride (DODAC); N-(2,3-dioleyloxy)propyl)-N,N,N-trimethylammonium chloride (DOTMA); N,N-distearyl-N,N-dimethylammonium bromide (DDAB); N-(2,3dioleoyloxy)propyl)-N,N,N-trimethylammonium chloride (DOTAP); 3-(N—(N',N'dimethylaminoethane)-carbamoyl)cholesterol (DC-Chol), N-(1-(2,3-dioleoyloxy)propyl)N-2-(sperminecarboxamido)ethyl)-N, N-dimethylammonium trifluoracetate (DOSPA), dioctadecylamidoglycyl carboxyspermine (DOGS), 1,2-dioleoyl-3-dimethylammonium propane (DODAP), N,N-dimethyl-2,3-dioleoyloxy)propylamine (DODMA), and N-(1, 2dimyristyloxyprop-3-yl)-N,N-dimethyl-N-hydroxyethyl ammonium bromide (DMRIE).

Additionally, a number of commercial preparations of cationic lipids are available which can be used in the present invention. These include, for example, LIPOFECTIN® (commercially available cationic liposomes comprising DOTMA and 1,2-dioleoyl-sn-3phosphoethanolamine (DOPE), from GIBCO/BRL, Grand Island, N.Y.); LIPOFECTAMINE® (commercially available cationic liposomes comprising N-(1-(2,3dioleyloxy)propyl)-N-(2-(sperminecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.). The following lipids are cationic and have a positive charge at below physiological pH: DODAP, DODMA, DMDMA, 1,2-dilinoleyloxy-N,N-dimethylaminopropane (DLinDMA), 1,2-dilinolenyloxy-N,N-dimethylaminopropane (DLenDMA).

The further cationic lipid may also be an amino lipid. Representative amino lipids include, but are not limited to, 1,2-dilinoleyoxy-3-(dimethylamino)acetoxypropane (DLinDAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA.Cl), 1,2-dilinoleoyl-3-trimethylaminopropane chloride salt (DLin-TAP.Cl), 1,2-dilinoleyloxy-3-(N-methylpiperazino)propane (DLin-MPZ), 3-(N, Ndilinoleylamino)-1,2-propanediol (DLinAP), 3-(N,N- dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[1,3]-dioxolane (DLin-KC2-DMA); dilinoleyl-methyl-4-dimethylaminobutyrate (DLin-MC3-DMA); MC3 (US20100324120).

Other suitable (cationic) lipids are disclosed in WO2009/086558, WO2009/127060, WO2010/048536, WO2010/054406, WO2010/088537, WO2010/129709, WO2011/153493, US2011/0256175, US2012/0128760, US2012/0027803, and U.S. Pat. No. 8,158,601. In that context, the disclosures of WO2009/086558, WO2009/127060, WO2010/048536, WO2010/054406, WO2010/088537, WO2010/129709, WO2011/153493, US2011/0256175, US2012/0128760, US2012/0027803, and U.S. Pat. No. 8,158,601 are incorporated herewith by reference.

In a particularly preferred embodiment the LNP comprises a cationic lipid with the formula (III) according to the patent application PCT/EP2016/075929. In this context, the disclosure of PCT/EP2016/075929 relating to cationic lipids is incorporated herewith by reference.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the RNA which is used as cargo. The N/P ratio may be calculated on the basis that, for example, 1 µg RNA typically contains about 3 nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

In certain embodiments, the LNP comprises one or more additional lipids which stabilize the formation of particles during their formation.

Suitable stabilizing lipids include neutral lipids and anionic lipids. The term "neutral lipid" refers to any one of a number of lipid species that exist in either an uncharged or neutral zwitterionic form at physiological pH. Representative neutral lipids include diacylphosphatidylcholines, diacylphosphatidylethanolamines, ceramides, sphingomyelins, dihydro sphingomyelins, cephalins, and cerebrosides.

Exemplary neutral lipids include, for example, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidylethanol amine (SOPE), and 1,2-dielaidoyl-sn-glycero-3-phophoethanolamine (transDOPE). In one embodiment, the neutral lipid is 1,2-distearoyl-sn-glycero-3phosphocholine (DSPC).

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

LNP in vivo characteristics and behavior can be modified by addition of a hydrophilic polymer coating, e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids).

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

In certain embodiments, the LNP comprises an additional, stabilizing-lipid which is a polyethylene glycol-lipid (PEGylated lipid). Suitable polyethylene glycol-lipids include PEG-modified phosphatidylethanolamine, PEG-modified phosphatidic acid, PEG-modified ceramides (e.g. PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the polyethylene glycol-lipid is N-[(methoxy poly(ethylene glycol)$_{2000}$)carbamyl]-1,2-dimyristyloxlpropyl-3-amine (PEG-c-DMA). In one embodiment, the polyethylene glycol-lipid is PEG-c-DOMG). In other embodiments, the LNPs comprise a PEGylated diacylglycerol (PEG-DAG) such as 1-(monomethoxy-polyethyleneglycol)-2,3-dimyristoylglycerol (PEG-DMG), a PEGylated phosphatidylethanoloamine (PEG-PE), a PEG succinate diacylglycerol (PEG-S-DAG) such as 4-O-(2',3'-di(tetradecanoyloxy)propyl-1-O-(ω-methoxy(polyethoxy)ethyl)butanedioate (PEG-S-DMG), a PEGylated ceramide (PEG-cer), or a PEG dialkoxypropylcarbamate such as w-methoxy(polyethoxy)ethyl-N-(2,3di(tetradecanoxy)propyl)carbamate or 2,3-di(tetradecanoxy)propyl-N-(ω-methoxy(polyethoxy)ethyl) carbamate. In various embodiments, the molar ratio of the cationic lipid to the PEGylated lipid ranges from about 100:1 to about 25:1.

The total amount of nucleic acid, particularly the RNA in the lipid nanoparticles varies and may be defined depending on the e.g. RNA to total lipid w/w ratio. In one embodiment of the invention the RNA to total lipid ratio is less than 0.06 w/w, preferably between 0.03 w/w and 0.04 w/w.

The composition, pharmaceutical composition, or vaccine comprising at least one (adapted) RNA according to the invention may be provided in liquid and or in dry (e.g. lyophylized) form. In a preferred embodiment, the RNA according to the invention or the composition is provided in lyophilized form. The RNA and the composition thus provide a possibility to store (irrespective of the ambient temperature and also without cooling) an RNA and a composition suitable for vaccination against, for example, an infectious disease, such as an infection with influenza virus or norovirus. Preferably, the at least one lyophilized RNA or composition is reconstituted in a suitable buffer, advantageously based on an aqueous carrier, e.g. Ringer-Lactate solution, prior to use, such as administration to a subject.

In a preferred embodiment, the composition is a pharmaceutical composition or a vaccine, which typically comprises a safe and effective amount of at least one (adapted)

RNA as defined herein. As used herein, "safe and effective amount" means an amount of the RNA of the composition or vaccine as defined above, that is sufficient to significantly induce an immune response against, for example, an infectious disease as described herein, such as an infection with influenza virus. At the same time, however, a "safe and effective amount" is small enough to avoid serious side effects that is to say to permit a sensible relationship between advantage and risk. The determination of these limits typically lies within the scope of sensible medical judgment. In relation to the vaccine or composition, the expression "safe and effective amount" preferably means an amount of the RNA that is suitable for stimulating the adaptive immune system in such a manner that no excessive or damaging immune reactions are achieved but, preferably, also no such immune reactions below a measurable level. Such a "safe and effective amount" of the RNA of the composition or vaccine as defined above may furthermore be selected, for example in dependence of the type of RNA, e.g. monocistronic, bi- or even multicistronic mRNA, since a bi- or even multicistronic mRNA may lead to a significantly higher expression of the encoded polypeptide(s) than use of an equal amount of a monocistronic mRNA. A "safe and effective amount" of the RNA of the composition or vaccine as defined above may furthermore vary in connection with the particular objective of the treatment and also with the age and physical condition of the patient to be treated, and similar factors, within the knowledge and experience of the accompanying doctor. The vaccine or composition according to the invention can be used according to the invention for human and also for veterinary medical purposes, as a pharmaceutical composition or as a vaccine.

In a preferred embodiment, the RNA of the composition, vaccine or kit of parts according to the invention is provided in lyophilized form. Preferably, the lyophilized RNA is reconstituted in a suitable buffer, advantageously based on an aqueous carrier, prior to administration, e.g. Ringer-Lactate solution, which is preferred, Ringer solution, a phosphate buffer solution.

According to a preferred embodiment, the buffer suitable for injection may be used as a carrier in the inventive vaccine or composition or for resuspending the inventive vaccine or the inventive composition. Such a buffer suitable for injection may be, for example, the liquid or non-liquid basis/carrier as described herein. Ringer-Lactate solution is particularly preferred as a liquid basis.

The choice of a pharmaceutically acceptable carrier is determined, in principle, by the manner, in which the vaccine or the composition is administered. The vaccine or composition can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, the vaccine or the composition may be administered by an intradermal, subcutaneous, or intramuscular route, preferably by injection, which may be needle-free and/or needle injection. Compositions/vaccines are therefore preferably formulated in liquid or solid form. The suitable amount of the vaccine or composition to be administered can be determined by routine experiments with animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

According to another embodiment, the (pharmaceutical) composition or the vaccine may comprise an adjuvant. An adjuvant may be used, for example, in order to enhance the immunostimulatory properties of the vaccine or composition. In this context, an adjuvant may be understood as any compound, which is suitable to support administration and delivery of the vaccine or composition according to the invention. Furthermore, such an adjuvant may, without being bound thereto, initiate or increase an immune response of the innate immune system, i.e. a non-specific immune response. In other words, when administered, the vaccine or composition according to the invention typically initiates an adaptive immune response due to the at least one antigenic peptide or protein contained in the vaccine or composition. Additionally, the vaccine or composition according to the invention may generate an (supportive) innate immune response due to addition of an adjuvant as defined herein to the vaccine or composition according to the invention.

Such an adjuvant may be selected from any adjuvant known to a skilled person and suitable for the present case, i.e. supporting the induction of an immune response in a mammal. Preferably, the adjuvant may be selected from the group consisting of, without being limited thereto, TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl-dodecanoyl-amide hydroacetate); CALCITRIOL™ (1-alpha,25-dihydroxy-vitamin D3); calcium phosphate gel; CAP™ (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i)N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L-alanyl-D-isoglutamine); imiquimod (1-(2-methypropyl)-1H-imidazo[4,5-c]quinoline-4-amine); ImmTher™ (N-acetylglucosaminyl-N-acetylmuramyl-L-Ala-D-isoGlu-L-Ala-glycerol dipalmitate); DRVs (immunoliposomes prepared from dehydration-rehydration vesicles); interferon-gamma; interleukin-1beta; interleukin-2; interleukin-7; interleukin-12; ISCOMS™; ISCOPREP 7.0.3.™; liposomes; LOXOR-IBINE™ (7-allyl-8-oxoguanosine); LT oral adjuvant (*E. coli* labile enterotoxin-protoxin); microspheres and microparticles of any composition; MF59™; (squalene-water emulsion); MONTANIDE ISA 51™ (purified incomplete Freund's adjuvant); MONTANIDE ISA 720™ (metabolisable oil adjuvant); MPL™ (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (beta-glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULON™ (QS-21); Quil-A (Quil-A saponin); S-28463 (4-amino-otec-dimethyl-2-ethoxymethyl-1H-imidazo[4,5 c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethyltetracosan and 2,6, 10,15,19,23-hexamethyl-2,6,10,14,18,22-tetracosahexane); stearyltyrosine (octadecyltyrosine hydrochloride); Theramid® (N-acetylglucosaminyl-N-acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Further adjuvants that may be suitably used are also provided in WO2016/203025. With respect to suitable adjuvants that may be comprised in order to enhance the immunostimulatory properties of the composition according to the invention, the adjuvants according to claim 7 and/or claim 17 of WO2016/203025, and the disclosure relating thereto, are included herewith by reference.

In certain embodiments, the composition, the pharmaceutical composition, the immunogenic composition as defined herein may comprise at least one adjuvant, wherein the at least one adjuvant may be an nucleic acid adjuvant having the formula GlXmGn or nucleic acid adjuvant having the formula ClXmCn as disclosed in WO2008014979 and WO2009095226 respectively, the disclosure relating thereto incorporated herein by reference.

The vaccine or composition can additionally contain one or more auxiliary substances in order to further increase the immunogenicity. A synergistic action of the RNA of the composition or vaccine as defined herein and of an auxiliary substance, which may be optionally co-formulated (or separately formulated) with the vaccine or composition as described above, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response produced by the immune-stimulating adjuvant according to the invention to be enhanced and/or influenced in a targeted manner. Particularly preferred auxiliary substances are cytokines, such as monokines, lymphokines, interleukins or chemokines, that—additional to induction of the adaptive immune response by the encoded at least one antigen—promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, INF-alpha, IFN-beta, INF-gamma, GM-CSF, G-CSF, M-CSF, LT-beta or TNF-alpha, growth factors, such as hGH. Preferably, such immunogenicity increasing agents or compounds are provided separately (not co-formulated with the inventive vaccine or composition) and administered individually.

The vaccine or composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to the vaccine or composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

Preferably, the above compounds are formulated and administered separately from the above composition or vaccine (of the invention) containing the RNA according to the invention.

According to a preferred embodiment, the composition according to the invention comprises at least two RNA species, wherein the sequence of at least one RNA species is adapted by altering the number of A and/or U nucleotides in the sequence of the at least one RNA species with respect to the number of A and/or U nucleotides in the original RNA sequence, wherein at least one RNA species comprises at least one coding region encoding at least one peptide or protein derived from a Norovirus, or a fragment or a variant of said peptide or protein. Preferably, the at least one adapted RNA in the inventive composition comprises at least one coding region encoding a peptide or protein derived from a Norovirus, or a fragment or a variant of said peptide or protein. More preferably, the at least one coding region encodes a peptide or protein derived from a Norovirus as described herein, or a fragment or variant thereof. In some embodiments, the composition of the present invention is a Norovirus vaccine, more preferably a polyvalent Norovirus vaccine.

Suitable Norovirus antigens and antigenic peptides or proteins derived from Norovirus are described in international patent application PCT/EP2017/060673, which is hereby incorporated by reference in its entirety.

In preferred embodiments, the RNA (species) as used herein, preferably the original RNA (species) that is to be adapted or the adapted RNA (species), comprises at least one coding region, which encodes a peptide or protein (derived from a Norovirus) comprising or consisting of an amino acid sequence according to any one of SEQ ID NOs: 1-4410 as described in PCT/EP2017/060673, or a fragment or variant of any one of these amino acid sequences.

According to some embodiments, the RNA (species) used herein, preferably the original RNA (species) that is to be adapted, comprises at least one coding region comprising or consisting of a nucleic acid sequence according to any one of SEQ ID NOs: 4411-39690, 39713-39746 as described in PCT/EP2017/060673, or a fragment or variant of any one of these nucleic acid sequences.

In a further preferred embodiment, the composition according to the invention is a polyvalent Norovirus vaccine, which comprises at least two RNA species, wherein the sequence of at least one RNA species is adapted by altering the number of A and/or U nucleotides in the sequence of the at least one RNA species with respect to the number of A and/or U nucleotides in the original RNA sequence, wherein at least one RNA species comprises at least one coding region encoding at least one peptide or protein derived from an Norovirus, or a fragment or a variant of said peptide or protein, and wherein at least one RNA species comprises at least one coding region encoding a different peptide or protein derived from a Norovirus, or a fragment or a variant of said peptide or protein.

In a particularly preferred embodiment, the composition according to the invention is a polyvalent Norovirus vaccine, which comprises
a) at least one, or a plurality, or at least more than one RNA species comprising at least one coding region comprising or consisting of at least one nucleic acid sequence according to any one of SEQ ID NOs: 4411-39690, 39713-39746 as described in PCT/EP2017/060673, or a fragment or variant of any one of these nucleic acid sequences; and
b) at least one, or a plurality, or at least more than one adapted RNA species comprising at least one coding region encoding at least one peptide or protein derived from an Norovirus, or a fragment or a variant of said peptide or protein, the at least one coding region preferably comprising or consisting of at least one adapted nucleic acid sequence encoding an amino acid sequence according to any one of SEQ ID NOs: 1-4410 as described in PCT/EP2017/060673, or a fragment or variant of any one of these nucleic acid sequences.

According to a particularly preferred embodiment, the composition according to the invention comprises at least two RNA species, wherein the sequence of at least one RNA species is adapted by altering the number of A and/or U nucleotides in the sequence of the at least one RNA species with respect to the number of A and/or U nucleotides in the original RNA sequence, wherein at least one RNA species comprises at least one coding region encoding at least one peptide or protein derived from an influenza virus, or a fragment or a variant of said peptide or protein. Preferably, the at least one adapted RNA in the inventive composition comprises at least one coding region encoding a peptide or protein derived from an influenza virus, or a fragment or a variant of said peptide or protein. More preferably, the at least one coding region encodes a peptide or protein derived from an influenza virus as described herein, or a fragment or variant thereof. In some embodiments, the composition of the present invention is an influenza vaccine, more preferably a polyvalent influenza vaccine.

In a preferred embodiment, the composition comprises at least two RNA species as described herein, wherein at least one RNA species comprises at least one coding region encoding at least one antigen selected from hemagglutinin (HA) and/or neuraminidase (NA) of an influenza virus, or a fragment or variant thereof. More preferably, the at least one coding region of the RNA encodes at least one antigenic peptide or protein derived from hemagglutinin (HA) and/or neuraminidase (NA) of an influenza virus, or a fragment or variant thereof. In this context, the hemagglutinin (HA) and the neuraminidase (NA) may be chosen from the same influenza virus or from different influenza viruses (or different influenza virus strains, respectively).

Suitable influenza antigens and antigenic peptides or proteins derived from influenza virus are described in international patent applications PCT/EP2016/075862 and PCT/EP2017/060663, which are herein incorporated by reference in their entirety.

Preferably, the at least one RNA (species), preferably the original RNA (species) that is to be adapted or the adapted RNA (species), in the inventive composition comprises at least one coding region, which encodes a peptide or protein comprising or consisting of an amino acid sequence according to any one of SEQ ID NOs: 1-30504, 213713, 213738, 213739, 213787, 213792, 213797, 213802, 213996-214023, 214100-214127, 214212-214239, 214316-214343, 214420-214447, 214524-214551, 214628-214655, 214732-214759, 214836-214863, 214940-214967, 215044, 215049-215076, 215161, 215166-215193, 215278, 215283-215310, 215395, 215400-215427, 215512, 215517-215544 as described in PCT/EP2017/060663, or a fragment or variant of any one of these amino acid sequences.

According to some embodiments, the at least one RNA species, preferably the original RNA (species) that is to be adapted, in the inventive composition comprises at least one coding region comprising or consisting of a nucleic acid sequence according to any one of SEQ ID NOs: 30505-213528, 213529-213557, 213740-213746, 213788, 213789, 213793, 213794, 213798, 213799, 213803, 213804, 214024-214051, 214128-214155, 214240-214267, 214344-

214371, 214448-214475, 214552-214579, 214656-214683, 214760-214787, 214864-214891, 214968-214995, 215045, 215046, 215077-215104, 215162, 215163, 215194-215221, 215279, 215280, 215311-215338, 215396, 215397, 215428-215455, 215513, 215514, 215545-215572, 215629, 215632, 215638-215835, 215892, 215836-215889 as described in PCT/EP2017/060663, or a fragment or variant of any one of these nucleic acid sequences.

According to a particularly preferred embodiment, the at least one RNA species, preferably an adapted RNA species, in the inventive composition comprises at least one coding region comprising or consisting of a nucleic acid sequence according to any one of SEQ ID NO: 26 to 14079, 14080 to 16264, 16265 to 28640, 28641 to 30568 as disclosed herein, or a fragment or variant of any one of these nucleic acid sequences.

In a further preferred embodiment, the composition according to the invention is a polyvalent influenza vaccine, which comprises at least two RNA species, wherein the sequence of at least one RNA species is adapted by altering the number of A and/or U nucleotides in the sequence of the at least one RNA species with respect to the number of A and/or U nucleotides in the original RNA sequence, wherein at least one RNA species comprises at least one coding region encoding at least one peptide or protein derived from an influenza virus, or a fragment or a variant of said peptide or protein, and wherein at least one RNA species comprises at least one coding region encoding a different peptide or protein derived from an influenza virus, or a fragment or a variant of said peptide or protein. More preferably, the composition comprises at least one RNA species encoding a peptide or protein derived from influenza HA, or a fragment or variant thereof, and at least one other RNA species encoding a peptide or protein derived from influenza NA, or a fragment or variant thereof, wherein at least one of said RNA species is an adapted RNA as described herein.

In a particularly preferred embodiment, the composition according to the invention is a polyvalent influenza vaccine, which comprises
a) at least one, or a plurality, or at least more than one RNA species comprising at least one coding region comprising or consisting of at least one nucleic acid sequence according to any one of SEQ ID NOs: 30505-213528, 213529-213557, 213740-213746, 213788, 213789, 213793, 213794, 213798, 213799, 213803, 213804, 214024-214051, 214128-214155, 214240-214267, 214344-214371, 214448-214475, 214552-214579, 214656-214683, 214760-214787, 214864-214891, 214968-214995, 215045, 215046, 215077-215104, 215162, 215163, 215194-215221, 215279, 215280, 215311-215338, 215396, 215397, 215428-215455, 215513, 215514, 215545-215572, 215629, 215632, 215638-215835, 215892, 215836-215889 as described in PCT/EP2017/060663, or a fragment or variant of any one of these nucleic acid sequences; and
b) at least one, or a plurality, or at least more than one adapted RNA species comprising at least one coding region encoding at least one peptide or protein derived from an influenza virus, or a fragment or a variant of said peptide or protein, the at least one coding region preferably comprising or consisting of at least one nucleic acid sequence according to any one of SEQ ID NO: 26 to 14079, 14080 to 16264, 16265 to 28640, 28641 to 30568 as disclosed herein, or a fragment or variant of any one of these nucleic acid sequences.

Method for Producing an RNA Composition

A further aspect of the present invention concerns a method for producing an RNA composition as described herein. The method is preferably for producing an RNA composition, preferably a (polyvalent) vaccine, comprising at least two RNA species, wherein the sequence of at least one RNA species has been adapted by altering the number of A and/or U nucleotides in the sequence of the at least one adapted RNA species, preferably as described herein, more preferably as described herein with respect to the method for modifying the retention time of an RNA on a chromatographic column, to the method for purifying at least one RNA species from a mixture of at least two RNA species, to the method for co-purifying at least two RNA species from a mixture comprising at least two RNA species, to the method for harmonizing the numbers of A and/or U nucleotides in the sequences of at least two RNA species, to the method fro providing an adapted RNA or to the composition or vaccine as described herein.

In a preferred embodiment, the method provides a system, which allows for fast and efficient production of a composition comprising at least two RNA species, which are selected from a pool of a RNA species. Starting out from a pool of RNA species/sequences, the at least two RNA species of the composition can quickly be exchanged by the methods laid out herein. The concept is also illustrated by FIG. 3 and Example 7. For example, in the case of a polyvalent influenza vaccine, from an AU adapted RNA sequence pool, RNA species encoding antigens, e.g. HA and/or NA antigens, can easily be exchanged ("+": addition of new RNA species to the RNA mixture; "−": removal of RNA species from the mixture) for e.g. seasonal influenza vaccine production (see FIG. 3; A: season A; B: season B; C: season C). In that manner, the method allows for quick seasonal adaptation of the influenza vaccine. The outlined concept is also suitable for other fast-adapting pathogens, e.g. Norovirus, and may be used to quickly adapt RNA based Norovirus vaccines.

The method may thus preferably involve the steps of adapting the sequence of at least one RNA sequence, which is comprised in the composition. Methods for producing RNA are known in the art and described herein.

Kits

According to another aspect, the present invention also provides kits, particularly kits of parts, comprising at least one (adapted) RNA (species) according to the invention, the composition comprising at least one (adapted) RNA (species) according to the invention, optionally a liquid vehicle for solubilising and optionally technical instructions with information on the administration and dosage of the (adapted) RNA (species) as described herein. Preferably, the (adapted) RNA (species) as described herein or the composition comprising at least one (adapted) RNA (species) according to the invention is provided in a separate part of the kit, wherein the (adapted) RNA (species) as described herein or the composition comprising at least one (adapted) RNA (species) according to the invention are preferably lyophilised. More preferably, the kit further contains as a part a vehicle for solubilising the RNA as described herein, the composition comprising at least one RNA (species) according to the invention, the vehicle preferably being Ringer-lactate solution. Any of the above kits may be used in a treatment or prophylaxis as defined herein. More preferably, any of the above kits may be used as a vaccine, preferably a vaccine against infection with an infectious disease, such as an influenza virus infection or Norovirus infection.

(Medical) Use and Application:

The present invention furthermore provides several applications and uses of the (adapted) RNA (species) according to the invention, the composition/vaccine comprising at least one (adapted) RNA (species) according to the invention or of kits comprising same. In particular, the (pharmaceutical) composition or the vaccine may be used for human and also for veterinary medical purposes, preferably for human medical purposes, as a pharmaceutical composition in general or as a vaccine.

Consequently, in a further aspect, the present invention is directed to the first medical use of the (adapted) RNA (species) according to the invention, the composition/vaccine comprising at least one (adapted) RNA (species) according to the invention or the kit or kit of parts as defined herein as a medicament. In particular, the invention provides the use of at least one (adapted) RNA (species) as defined herein, or a fragment or variant thereof as described herein for the preparation of a medicament.

According to another aspect, the present invention is directed to the second medical use of the (adapted) RNA (species) according to the invention, the composition comprising at least one (adapted) RNA (species) according to the invention or the kit or kit of parts as described herein for the treatment of an infection with an influenza virus. In particular, the present invention provides the at least one (adapted) RNA (species) as described herein to be used for the preparation of a medicament, wherein the (adapted) RNA (species) as described herein is preferably formulated together with a pharmaceutically acceptable vehicle and an optionally additional adjuvant and an optionally additional further component as defined herein.

Further, the present invention is directed to the second medical use of the (adapted) RNA (species) according to the invention, the composition comprising at least one (adapted) RNA (species) according to the invention or the kit or kit of parts as described herein for the treatment of an infection with a Norovirus. In particular, the present invention provides the at least one (adapted) RNA (species) as described herein to be used for the preparation of a medicament, wherein the (adapted) RNA (species) as described herein is preferably formulated together with a pharmaceutically acceptable vehicle and an optionally additional adjuvant and an optionally additional further component as defined herein.

The composition or the vaccine comprising at least one (adapted) RNA (species) according to the invention can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, the vaccine may be administered by an intradermal, subcutaneous, or intramuscular route.

In a further aspect the invention provides a method of treating or preventing a disorder, wherein the disorder is preferably an infection with influenza virus or Norovirus, or a disorder related to an infection with influenza virus or Norovirus, wherein the method comprises administering to a subject in need thereof the (adapted) RNA (species) according to the invention, the inventive composition comprising at least one (adapted) RNA (species) according to the invention, or the inventive kit or kit of parts.

In particular, such a method may preferably comprise the steps of:

a) providing the (adapted) RNA (species) according to the invention, the vaccine/composition comprising at least one (adapted) RNA (species) according to the invention, or the inventive kit or kit of parts described herein; and b) applying or administering the (adapted) RNA (species) according to the invention, the vaccine/composition comprising at least one (adapted) RNA (species) according to the invention, or the kit or kit of parts described herein to a tissue or an organism.

BRIEF DESCRIPTION OF THE DRAWINGS

FIGS. 1A and 1B: RNA molecule species of an RNA mixture differ in their retention times. Impurities such as abortive sequences cannot be separated from each other. In addition, as the histograms partially overlap, quality attributes, such as integrity of the individual species, cannot be determined. FIG. 1A shows the separate histograms for each RNA species in the mixture.

FIGS. 1C and 1D: In rare cases, three RNA species of an RNA mixture may have similar retention times, and impurities such as abortive sequences could be separated from each other. In addition, as the peaks entirely overlap, quality attributes, such as integrity of the whole RNA mixture, could be determined. FIG. 1C shows the separate histograms for each RNA species in the mixture. FIG. 1E: RNA species have different retention times. As the histograms are entirely separated from each other, quality attributes, such as integrity of individual RNA species of the RNA mixture, can be determined.

FIG. 2A: As initial step of the adaptation method/algorithm, all codons of the nucleic acid sequence are categorized and potential exchanges with alternative codons are allocated for each individual codon (codon changes that allow increase or decrease of AU count are listed in Table 1 and Table 2). In FIG. 2A, codons labeled with an asterisk (*) may allow for an increase in AU count if the respective codon is changed accordingly; codons labeled with a hash (#) may allow for a decrease in AU count if the respective codon is changed accordingly; codons labeled with a cross ("x") do not lead to a change in AU count. FIG. 2B shows the adaptation of the input nucleic acid sequence to an AU count increased target sequence. All four codons, which can potentially be replaced by alternative codons, are changed to the codon with a larger AU count (codons highlighted). FIG. 2C shows the adaptation of the input nucleic acid sequence to an AU decreased target sequence. All three codons, which can potentially be replaced by alternative codons, are changed to the codon with a lower AU count (codons highlighted).

removal of RNA species from the mixture) for e.g. seasonal influenza vaccine production (A: season A; B: season B; C: season C). The general concept can also be used for trend line for silica-based C4 column with flowrate 1.0, cf.

EXAMPLES

The Examples shown in the following are merely illustrative and shall describe the present invention in a further way. These Examples shall not be construed to limit the present invention thereto.

TABLE 3

| Materials used | |
|---|---|
| U3000 UH PLC-System | Thermo Scientific |
| HPLC column poly(styrene-divinylbenzen) matrix) | Thermo Scientific |
| WFI | Fresenius Kabi, Ampuwa |
| Acetonitril (MS-grade) | Fisher Scientific |
| 0.1M TEAA in WFI (Eluent A) | |
| 25% ACN in 0.1M TEAA (Eluent B) | |

Example 1: Examination of the Correlation Between Homopolymer Stretches of Nucleotides on HPLC Retention Times The inventors surprisingly found that not the size of an RNA, but the total number of adenine nucleotides (A nucleotides) and/or uracil nucleotides (U nucleotides) of an RNA is influencing HPLC retention times. Further details are provided in the following.

1.1. Preparation of DNAs Encoding Firefly Luciferase Including Varying Stretches of Adenines:

The DNA sequence encoding firefly luciferase protein was introduced into a modified pUC19 derived vector backbone to comprise a 5'-UTR derived from the 32L4 ribosomal protein (32L4 TOP 5'-UTR) and a 3'-UTR derived from albumin, a histone-stem-loop structure, and stretches of varying numbers of adenine nucleotides (also referred to in the following as 'polyA stretch' or 'A homopolymer') at the 3'-terminal end and. The complete RNA sequences are provided in the sequence listing (see Table 4 below).

TABLE 4

| Constructs used in the experiment | | |
|---|---|---|
| Encoded protein | Length of polyA stretch | SEQ ID NO: |
| luciferase | A25 | 1 |
| | A35 | 2 |
| | A50 | 3 |
| | A64 | 4 |

DNA plasmids were linearized using EcoRI and transcribed in vitro using DNA dependent T7 RNA polymerase in the presence of a nucleotide mixture and cap analog under suitable buffer conditions. The obtained individual RNA products were purified using PureMessenger® as described in WO 2008/077592 A1 and subsequently analyzed using HPLC.

1.2 Determination of HPLC Retention Times:

Individual RNA samples were diluted to 0.1 g/L using water for injection (WFI). 10µl of the diluted RNA sample were injected into the HPLC column (monolithic poly (styrene-divinylbenzen) matrix). The RP HPLC analysis was performed using the following conditions:

Gradient 1: Buffer A (0.1 M TEAA (pH 7.0)); Buffer B (0.1 M TEAA (pH 7.0) containing 25% acetonitrile). Starting at 30% buffer B the gradient extended to 32% buffer B in 2 minutes, followed by an extension to 55% buffer B over 15 minutes at a flow rate of 1 ml/min (adapted from WO 2008/077592). Chromatograms were recorded at a wavelength of 260 nm.

Figure 4:
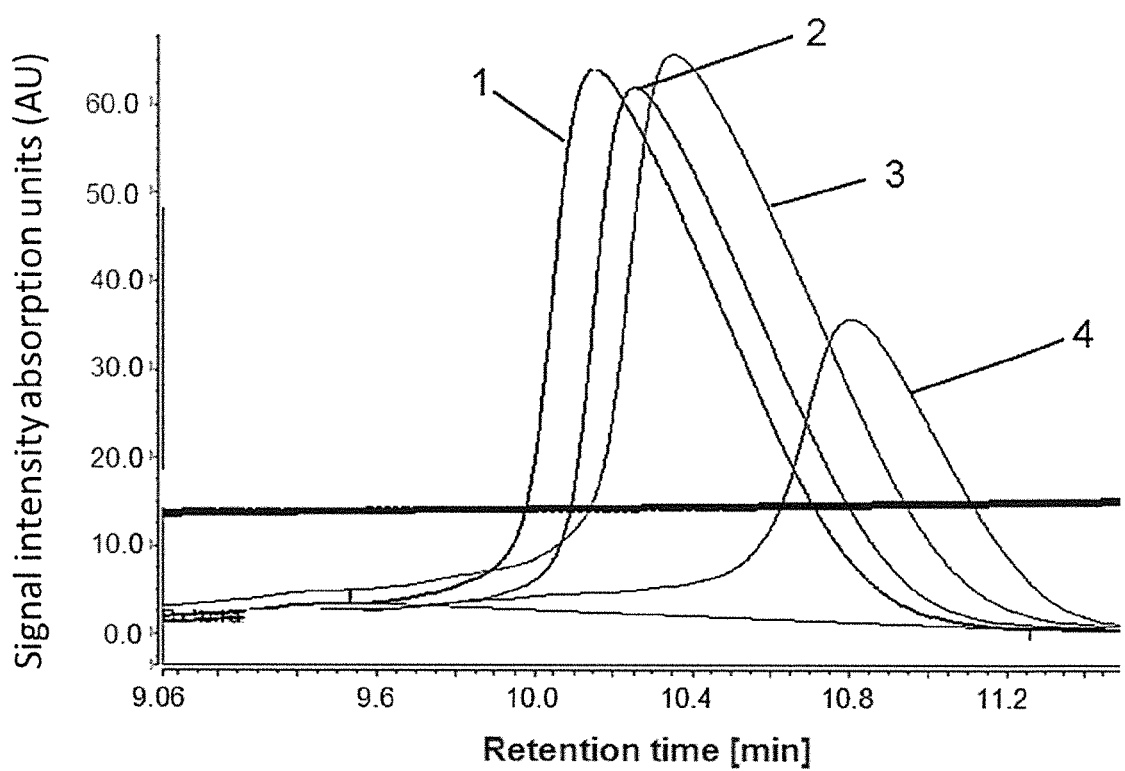

In order to examine an eventual correlation between the presence and the extent of nucleotide homopolymer stretches on the one hand and the HPLC retention time on the other hand, chromatograms of each HPLC analysis run were superimposed. FIG. 4 shows the superposition of HPLC runs of RNAs with varying stretches of adenine nucleotides.

Results

As shown in FIG. 4, the analysis of the HPLC retention time of different RNA molecule species differing only in the length of A nucleotide homopolymer stretches (i.e. in the total number of A nucleotides) show a clear correlation of the total number of A nucleotides in the RNA sequences and HPLC retention time. Longer A homopolymers led to an increase in retention time, suggesting that the observed effect on HPLC retention time is caused by the increased number of A nucleotides (+25 adenine nucleotides; +35 adenine nucleotides; +50 adenine nucleotides; +64 adenine nucleotides).

Notably, changes in the total number of cytosine nucleotides (C nucleotides) did not have an influence on HPLC retention time (not shown). As only the number of A nucleotides and not the number of C nucleotides influences HPLC retention times, an effect merely caused by elongation of the RNA molecule species can be ruled out.

Example 2: Harmonization of HPLC Retention Times of Different HA RNA Sequences for Co-Purification and/or Co-Analysis by Adaptation of the Adenine Count The inventors surprisingly found that the adaptation the total number of A nucleotides in two or more different RNA species (e.g. RNA molecules comprising different sequences encoding influenza HA-B) is suitable to harmonize the HPLC retention times, so that co-purification and/or co-analysis becomes feasible. Further details are provided in the following.

2.1. Adaptation of the Total Number of a Nucleotides:

As the previous examples show a correlation between the number of A nucleotides in an RNA sequence and the respective HPLC retention time, RNA sequences encoding HA antigens (four different RNA sequences encoding influenza HA) were adapted so that they comprised (essentially) the same number of A nucleotides. The sequence adaptation was performed in such a way that the encoded amino acid sequence was unchanged, either by exploiting the degeneracy of the genetic code (compare with Table 1 and Table 2) or by introducing an adenine stretch into the polyA tail or the UTR of the RNA molecule species.

Figure 1:
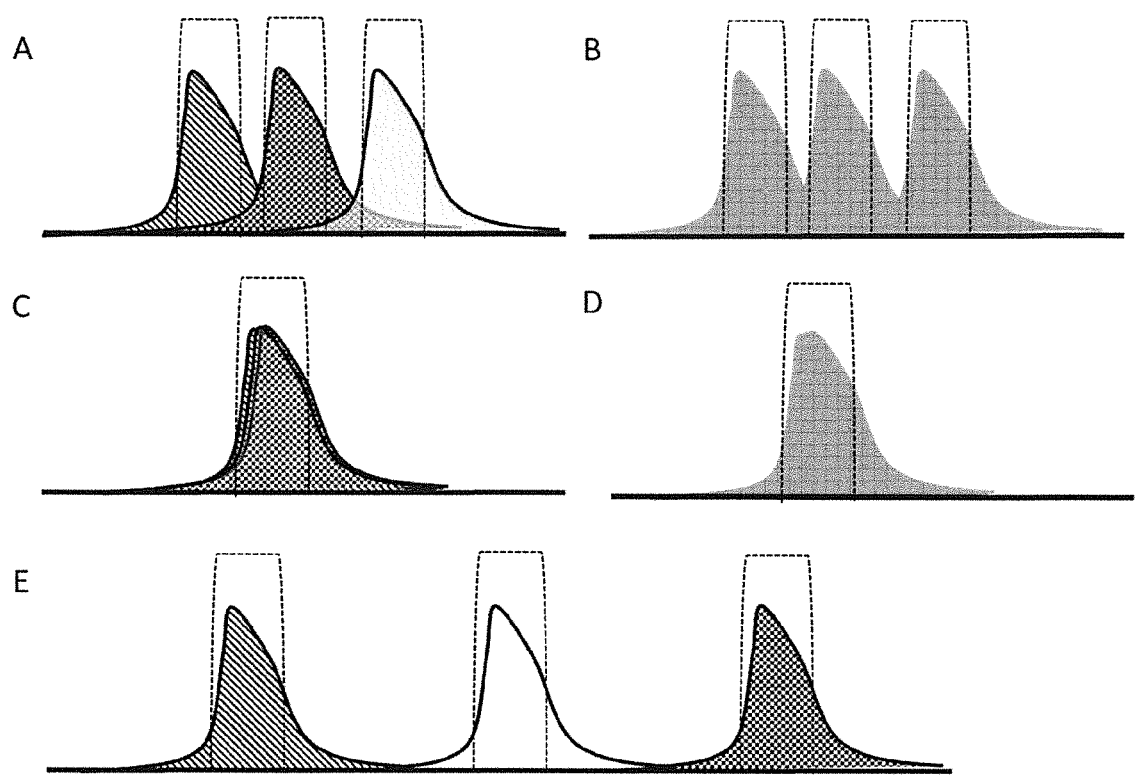
FIG. 1: illustrates the technical problem associated with HPLC co-purification and/or co-analysis of RNA mixtures. Schematic drawings of HPLC histograms (RNA mixture comprising different RNA molecule species) are shown.
Figure 2:
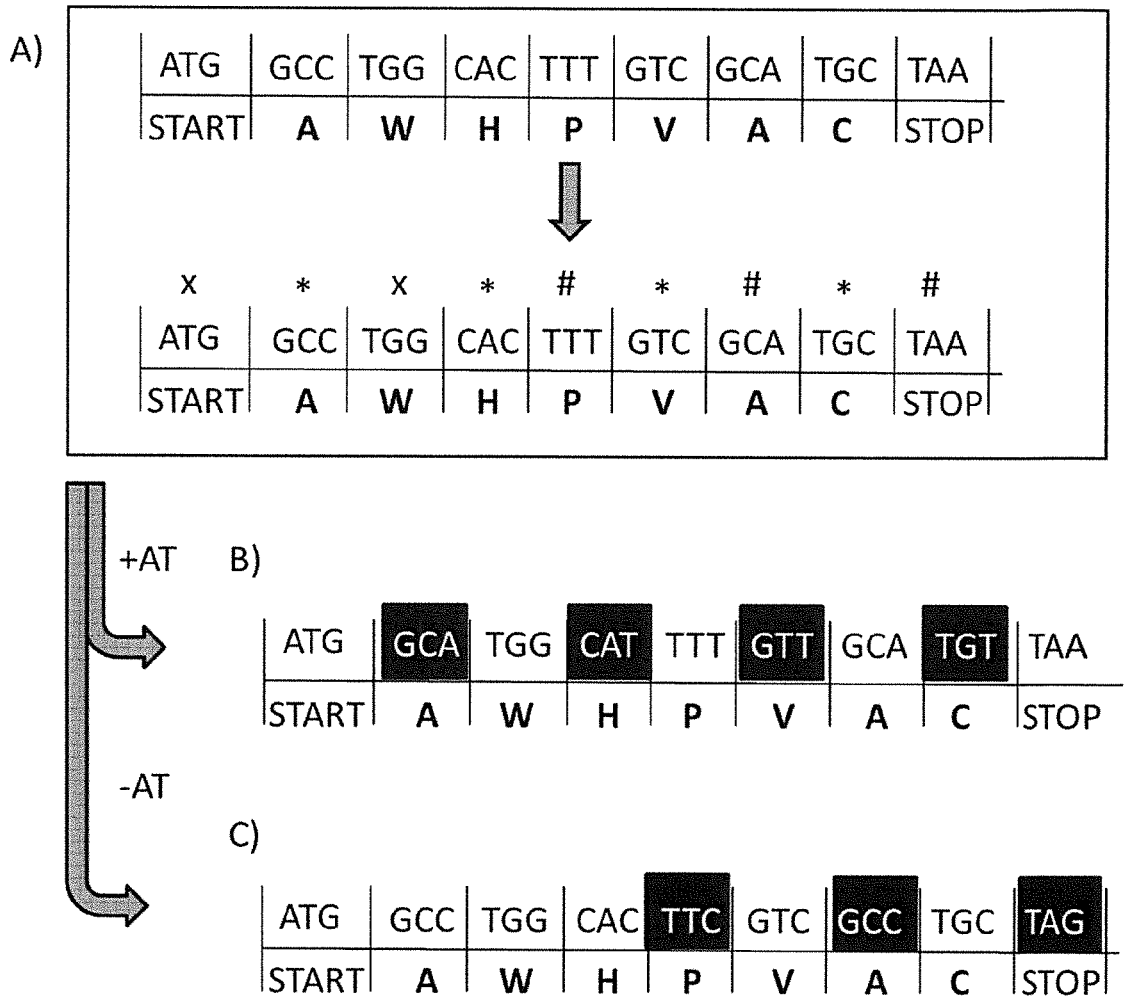
FIG. 2: illustrates the basic principle of adapting a given nucleic acid sequence encoding a short protein (amino acid sequence: AWHPVAC) to either increase the AU count or decrease the AU count.
Figure 3:
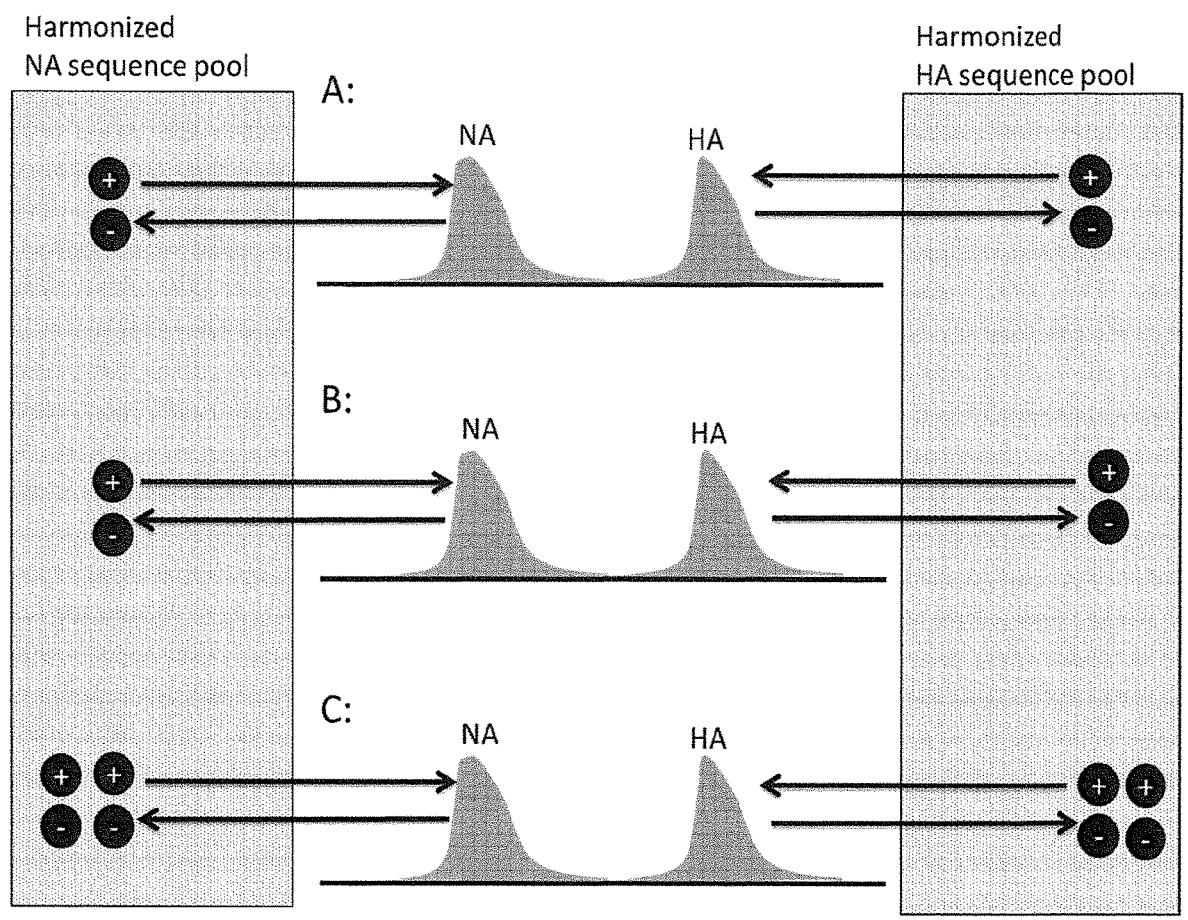
FIG. 3: illustrates the modular design principle of the inventive multivalent/polyvalent mRNA vaccine platform (e.g. influenza), where RNA species can be exchanged rapidly without changing the manufacturing conditions (HPLC purification and/or HPLC analysis). From an AU adapted RNA sequence pool, RNA species encoding antigens, e.g. HA and/or NA antigens, can easily be exchanged ("+": addition of new RNA species to the RNA mixture; "−"

The goal was to adapt the sequences in a way to facilitate co-purification and/or co-analysis of an RNA mixture comprising different HA RNA molecule species by obtaining a complete overlay of the four chromatograms (harmonization) in HPLC, which is a prerequisite for a cost-effective and fast production of an influenza vaccine based on an mRNA mixture (e.g., for the development of a multivalent/polyvalent influenza RNA vaccine platform, cf. FIG. 3).

In order to harmonize the retention times of all RNA molecule species encoding different HA antigens (HA-A and HA-B), GC-optimized DNA sequences encoding different HA proteins of Influenza B were adapted by increasing the number of A nucleotides by adapting the coding sequence (via codon exchange), by elongating the poly A sequence, or by introducing additional A nucleotides into the UTR region (see Table 5 below). The adaptation was performed by increasing the total number of A nucleotides in the HA-B sequences by 9 in order to shift the total number of A nucleotides in the HA-B sequences closer to the number of A nucleotides in the HA-A sequences. DNA constructs and RNA prepared as explained in Example 1.

simultaneous determination of the integrity of the RNAs in the mixture. Moreover, harmonization of HPLC retention times allows for a simultaneous RNA purification (co-purification).

Figure 6:
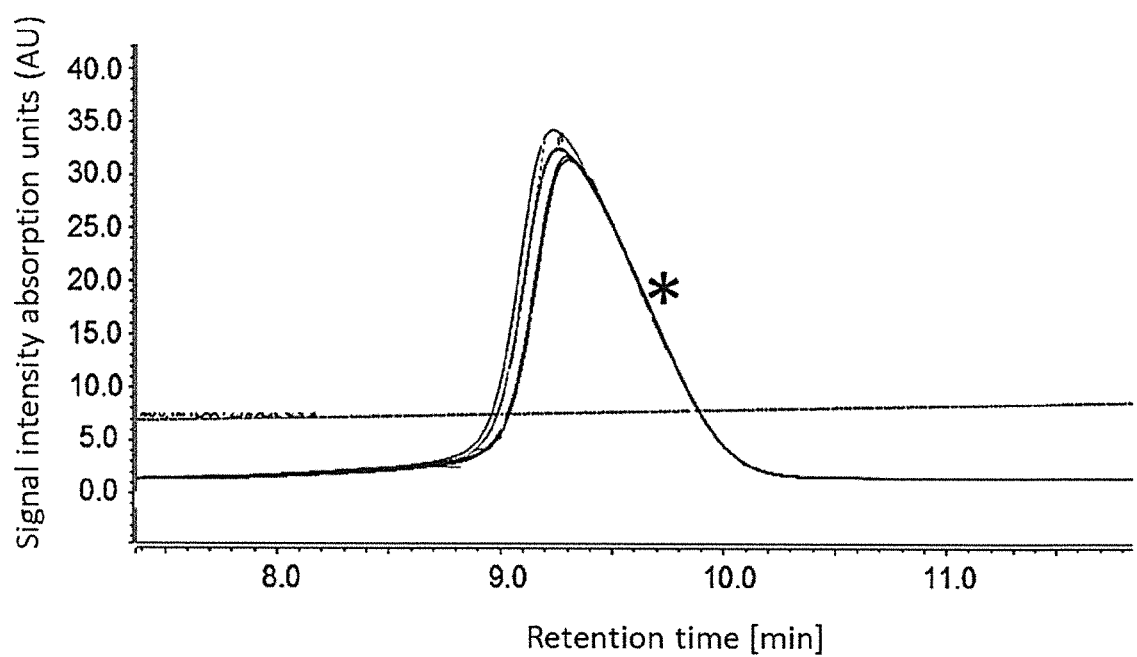

Of note, as analyzed and explained in further detail in Example 5, the surprisingly precise overlap of the HA-A sequences and adapted HA-B sequences as observed in FIG. 6 can also be explained by the closely matching number of A nucleotides and U nucleotides (AU count) of the respective RNA sequences (HA-B Brisbane: AU count 732; HA-B Phuket: AU count 726; HA-A California: AU count 737; HA-A Hongkong: AU count: 729; see Table 4).

TABLE 5

HA-constructs used in the experiment

| Encoded Antigen | Mode of adaptation | A count of RNA* | AU count of RNA** | SEQ ID NO: |
|---|---|---|---|---|
| HA-B Brisbane | Not adapted | 467 | 723 | 5 |
| | 9 A nucleotides introduced into cds by codon exchange | 476 | 732 | 6 |
| | 9 A stretch introduced into poly A tail | 476 | 732 | 7 |
| | 9 A stretch introduced into the UTR | 476 | 734 | 8 |
| HA-B Phuket | Not adapted | 458 | 717 | 9 |
| | 9 A nucleotides introduced into cds by codon exchange | 467 | 726 | 10 |
| | 9 A stretch in poly A tail | 467 | 726 | 11 |
| | 9 A stretch introduced into the UTR | 467 | 728 | 12 |
| HA-A California | Not adapted | 476 | 737 | 13 |
| HA-A Hongkong | Not adapted | 481 | 729 | 14 |

*A-count of RNA: total number of A nucleotides in the respective RNA
**AU-count of RNA: total number of A and U nucleotides in the respective RNA 2.2. Effect of the Total Number of a Nucleotides on HPLC Retention Time:

HPLC sample preparation and HPLC analysis were performed as described Example 1. In order to examine the effect of the number of A nucleotides on HPLC retention time, the chromatograms of each RNA species were superimposed and analyzed.

Figure 5A:
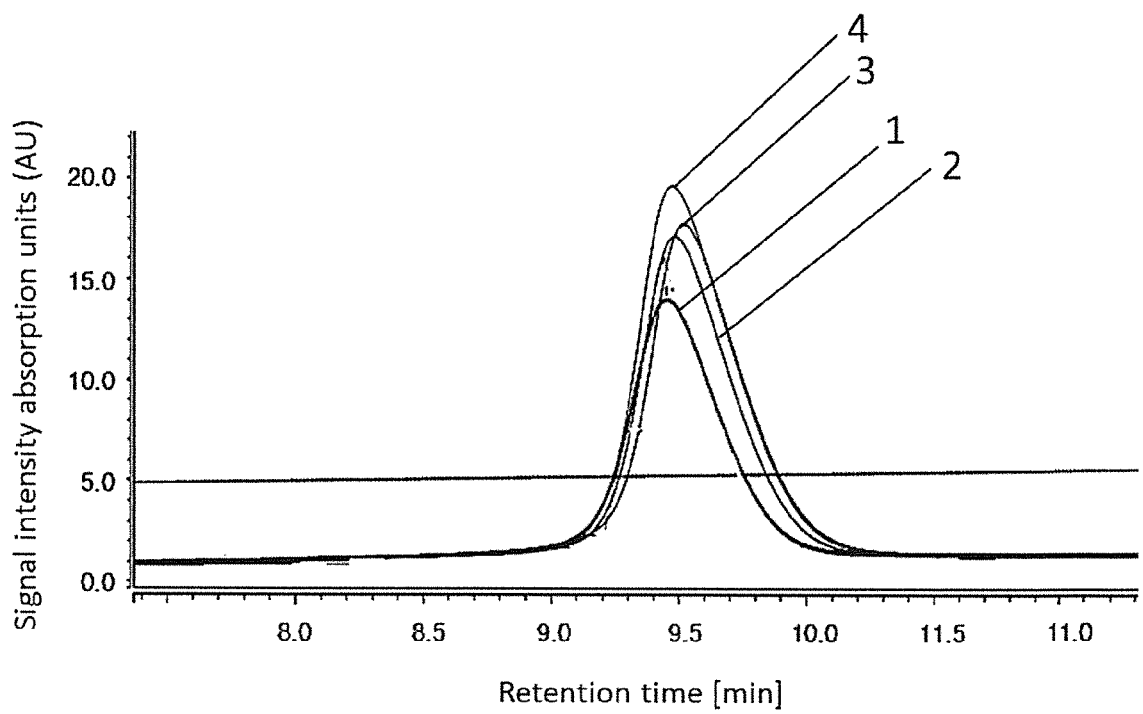
Figure 5B:
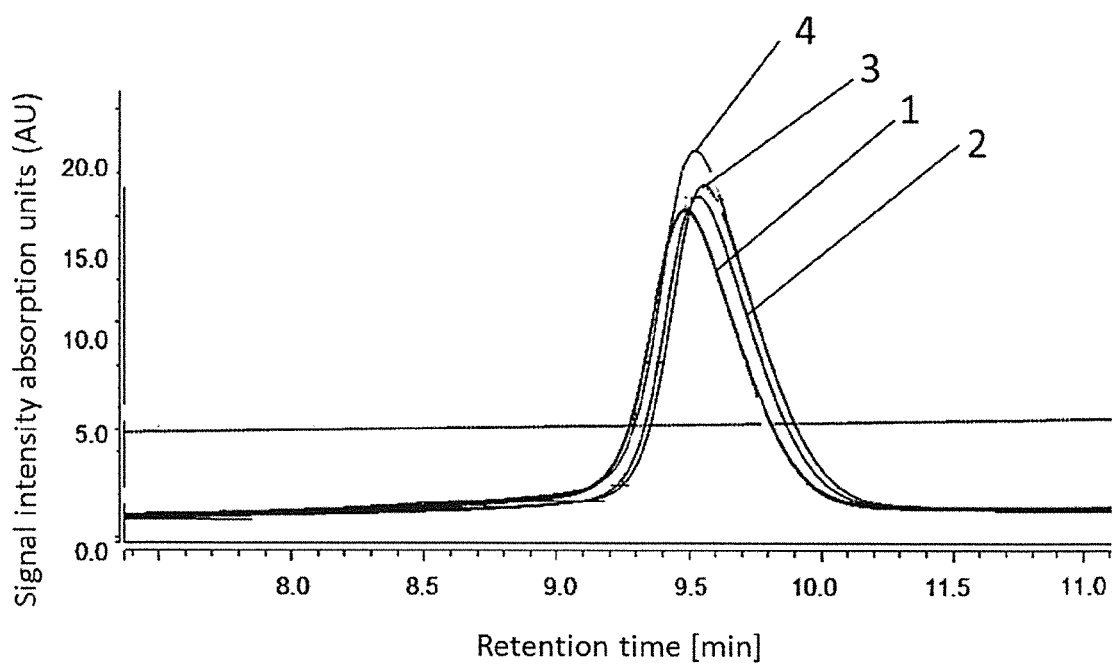

FIG. 5A shows four superimposed chromatograms for RNA molecule species encoding HA-B/Brisbane (one non-adapted sequence (1) and three adapted sequences (2, 3 and 4, respectively)). FIG. 5B shows four superimposed chromatograms for the RNA molecule species encoding HA-B/Phuket (one non-adapted sequence (1) and three adapted sequences (2, 3 and 4, respectively)). FIG. 6 shows superimposed chromatograms for adapted RNA molecule species (9 Adenines introduced into cds by codon exchange) encoding HA-B/Brisbane, adapted RNA molecule species encoding HA-B/Phuket and two non-adapted RNA molecule species encoding HA-A (HA-A California; HA-A Hongkong).

Results:

The results show that the adaptation of the number of A nucleotides in the RNA sequences (see FIG. 5A and FIG. 5B) by addition of 9 adenines led to a shift in HPLC retention time. As indicated in FIG. 5A and FIG. 5B, the effect of an A-stretch, either introduced into the UTR or introduced into the polyA tail had a slightly stronger effect on the retention time.

FIG. 6 shows that HA-B sequences were successfully adapted, and that HA-A peaks and HA-B peaks are harmonized. This adaptation of the sequences, which results in completely overlapping HPLC peaks, allows for co-analysis of the individual RNA species in the mixture and for Example 3: Evaluation of Suitability of HPLC for Co-Analysis of RNA Mixture The inventors showed that HPLC is a particularly suitable method for co-analysis of an RNA mixture. Further details are provided in the following.

3.1. Preparation of Test RNA:

RNA for testing the HPLC system was generated according to Example 1.

3.2. Directed Degradation of RNA and Preparation of RNA Mixtures of Different Integrities:

RNA samples were degraded at 90° C. for 140 minutes. Subsequently, intact RNA and degraded RNA were mixed in different ratios of intact RNA: degraded RNA (90:10, 80:20, 70:30, 60:40, 50:50, 40:60, 30:70, 20:80, and 10:90) and respective RNA mixtures of varying integrities were applied to analytic HPLC. Analytic HPLC was performed as described in Example 1. For analysis, HPLC runs of the different RNA mixtures were superimposed. The results are shown in FIG. 7.

Figure 7:
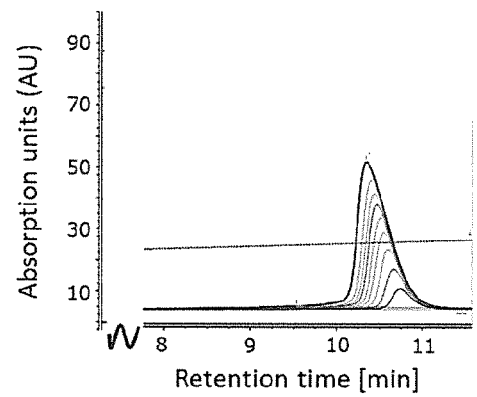
Figure 7:
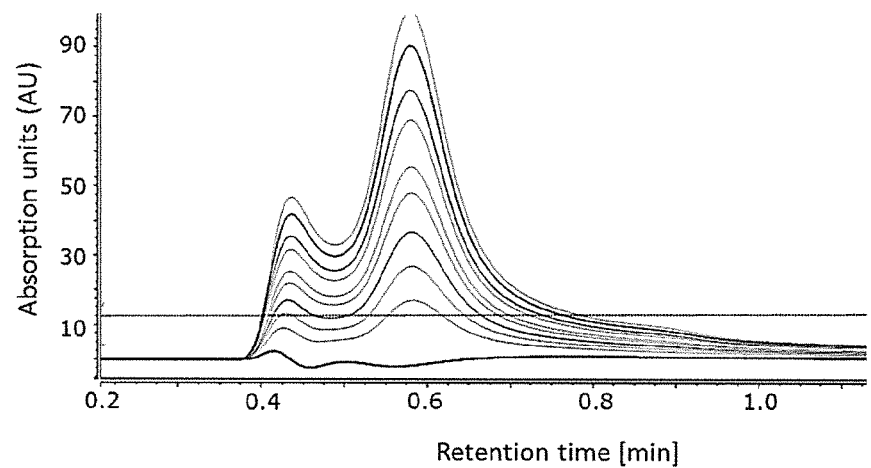
Figure 8A:
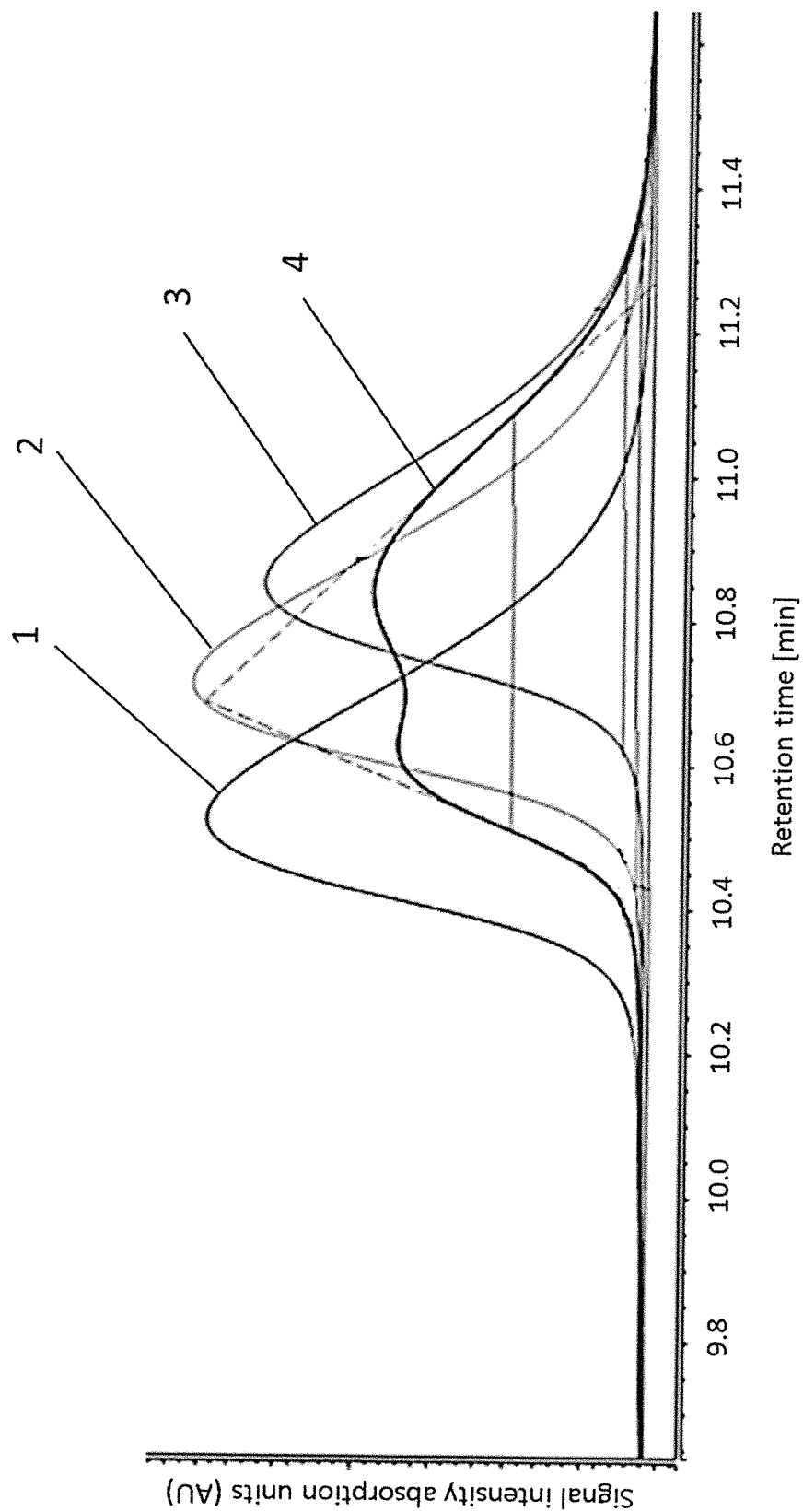
Figure 8B:
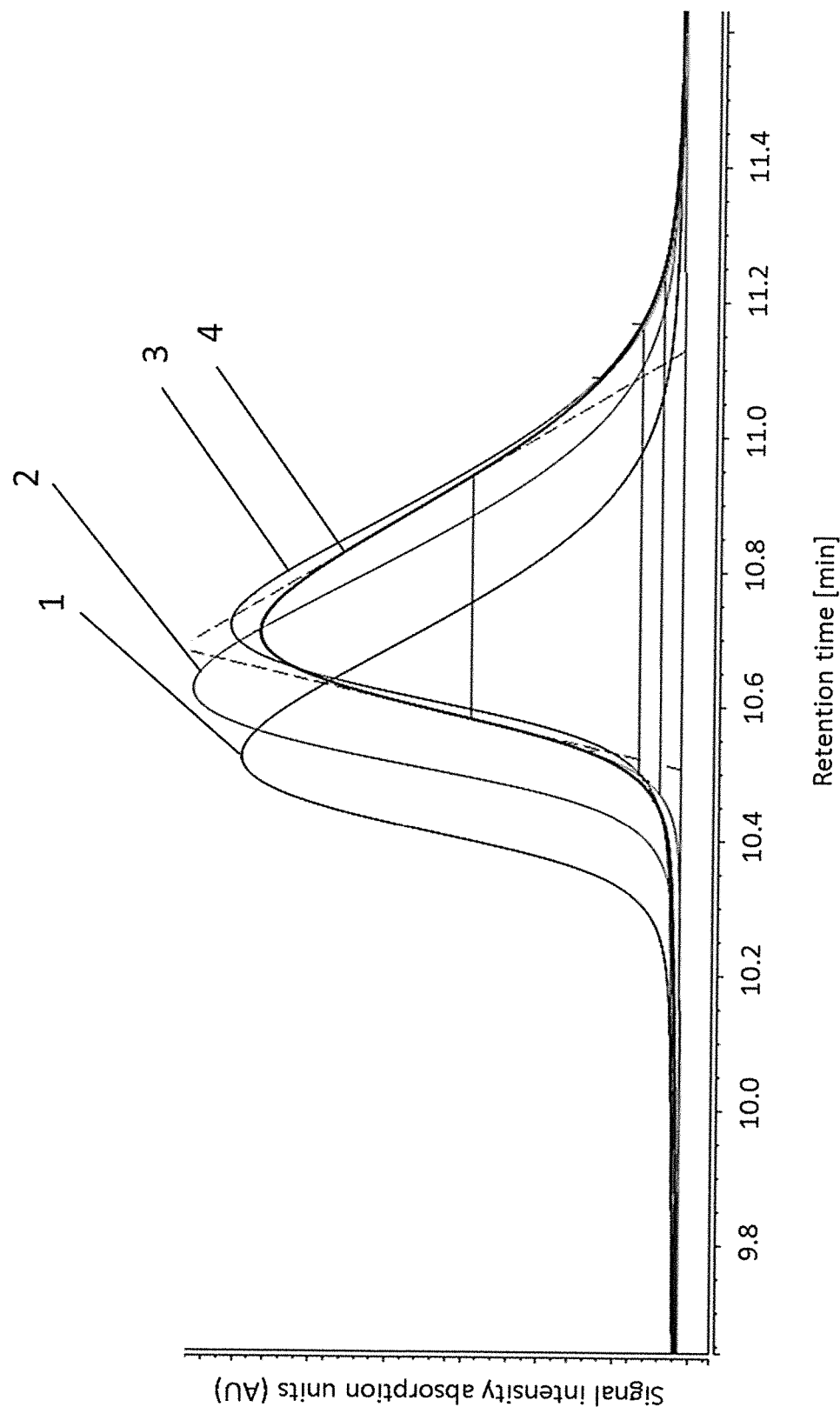
Figure 9:
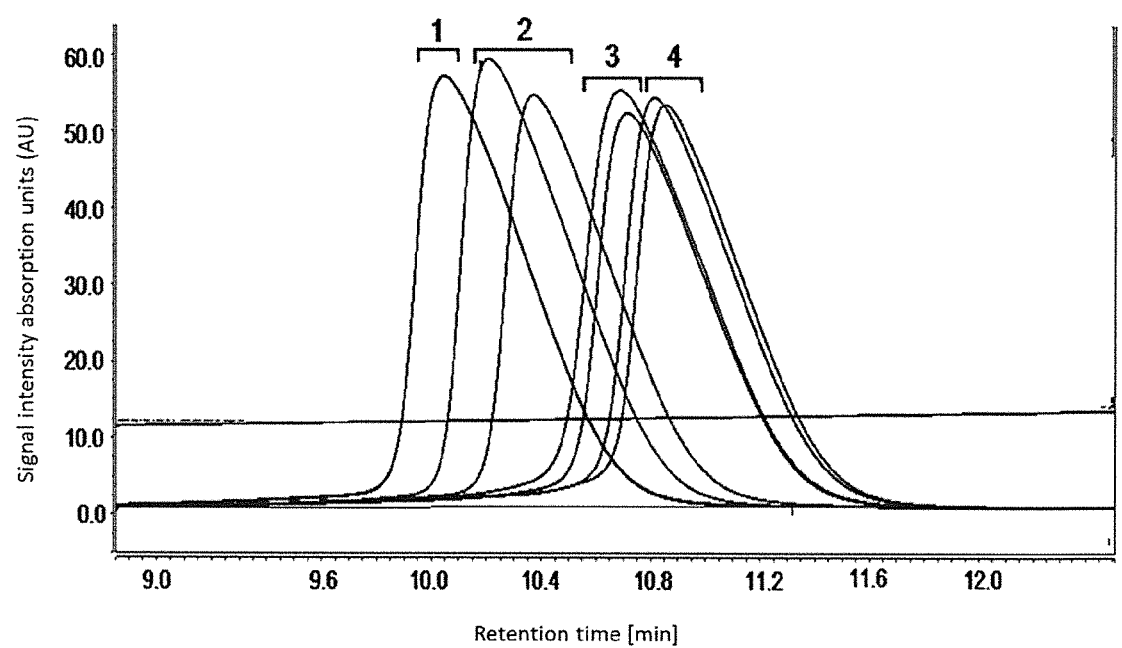

Results:

As FIG. 7 shows, RNA integrity of an RNA mixture can be determined in a scenario where the RNA mixture has the same retention time (harmonized RNA peak; peak of the individual RNA components, in that case integer RNA and degraded RNA, are completely overlapping). Accordingly, the analytic system is suitable for the analysis of a (polyvalent) RNA mixture according to the present invention.

Example 4: Harmonization of HPLC Retention Times of NA RNA Sequences for Co-Purification and/or Co-Analysis by Adaptation of the Number of a Nucleotides The inventors surprisingly found that an RNA mixture (encoding three different NA antigens) comprising RNA species with an adapted number of A nucleotides generates one harmonized HPLC peak, suitable for co-analysis and co-purification. Further details are provided in the following.

Figure 10A:
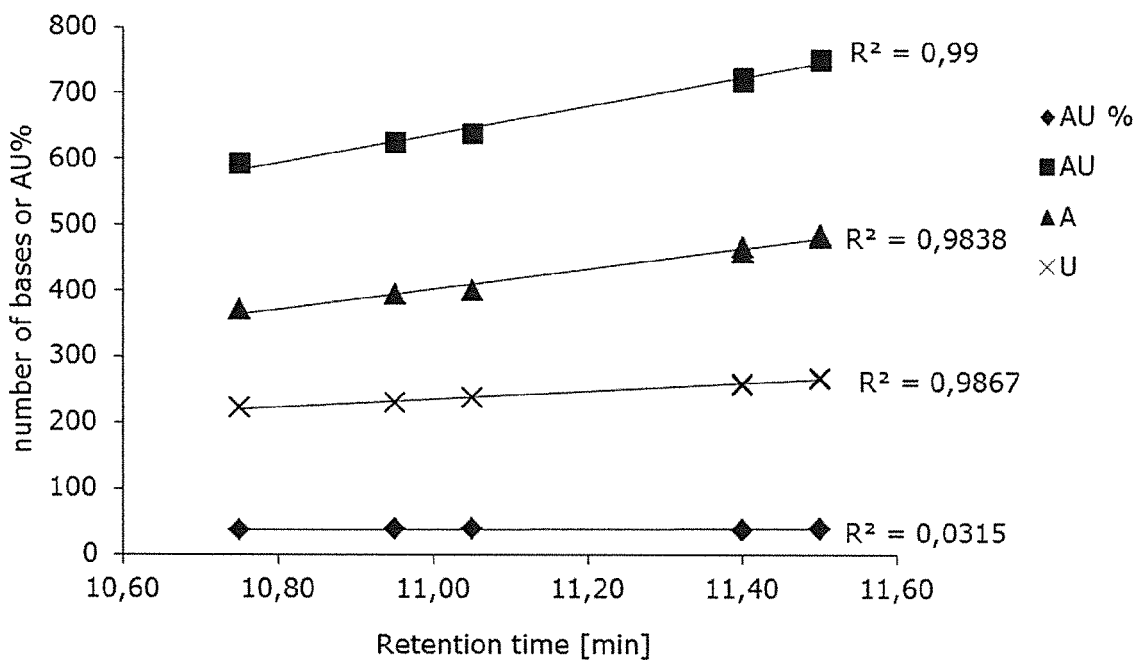
Figure 10B:
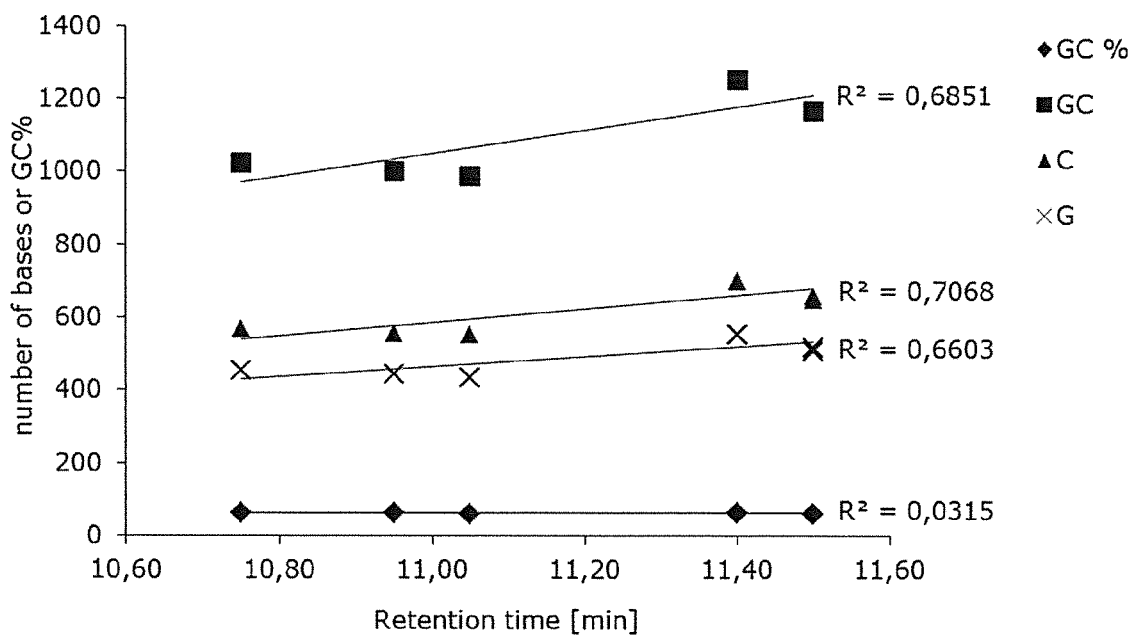

4.1. Adaptation of the Number of a Nucleotides in DNA Encoding NA Proteins of Several Influenza Strains:

The goal was to adapt NA RNA sequences in a way to facilitate co-purification and/or co-analysis of an RNA mixture of different NA RNA molecule species by obtaining a complete overlay of the three chromatograms, which is a prerequisite for a cost-effective and fast production of an RNA-mixture based influenza vaccine (e.g. for the development of a multivalent influenza RNA vaccine, cf. FIG. 3)

In order to harmonize the retention time of all RNA molecule species encoding different NA antigens, GC-optimized DNA sequences encoding different NA proteins of Influenza were adapted by decreasing the number of A nucleotides by altering the coding sequence (codon exchange; see Table 6 below). The adaptation was performed in order to decrease the number of A nucleotides in RNA encoding NA H3N2 and mRNA encoding NA H1N1 to essentially match the number of A nucleotides in RNA encoding NA Influenza B.

DNA constructs and RNA were prepared as explained in Example 1.

TABLE 6

NA-constructs used in the experiment

| Encoded Antigen | Mode of adaptation | SEQ ID NO: |
|---|---|---|
| NA Influenza B (Brisbane) | Not adapted | 15 |
| NA H3N2 | Not adapted | 16 |
| (Hongkong) | 17 A removed from cds by codon exchange | 17 |
| NA H1N1 | Not adapted | 18 |
| (California) | 16 A removed from cds by codon exchange | 19 |

4.2. Effect of the Number of a Nucleotides on HPLC Retention Time:

HPLC sample preparation and HPLC analysis were performed as described in Example 1.

In order to examine the effect of the number of A nucleotides on HPLC retention time, the chromatograms of non-adapted RNA species were superimposed and analyzed. In addition, non-adapted RNA molecule species were mixed (100 ng each), applied as a mixture, and analyzed by HPLC (see FIG. 8A). In addition, adapted NA H3N2 (Hongkong) RNA, adapted NA H3N2 (California) RNA, and NA Influenza B (Brisbane) RNA were mixed (100 ng each) and applied as a mixture, and analyzed by HPLC (see FIG. 8B). FIG. 8A shows superimposed chromatograms for non-adapted RNA molecule species encoding NA (1, 2, 3) next to the chromatogram of the corresponding RNA mixture (4). FIG. 8B shows the chromatogram of the harmonized NA RNA mixture (4).

Results

The results show that the adaptation of the number of A nucleotides in the individual RNA sequences of an RNA mixture leads to adaptation of the retention time of the RNA mixture and a discrete HPLC peak (see FIG. 8B), which allows for co-analysis and co-purification (even though the individual HPLC peaks show a slight variation). In contrast, a non-adapted RNA mixture generates a broad, non-discrete HPLC double-peak (see FIG. 8B) that is not suitable for co-analysis and co-purification.

Of note, the adaptation (reduction) of the number of A nucleotides in SEQ ID NOs: 17 and 19 was performed by changing serine codon AGC to codon UCC, which led to a decrease in A count and to an increase in U count (AU count was therefore stable; ratio of A:U was decreased), suggesting that the observed slight variation in the HPLC chromatograms of the individually analyzed adapted sequences was caused by a shift in the A:U ratio. Accordingly, adaptation of the A:U ratio can also be used for sequence adaptations according to the invention.

Example 5: Examination of the Influence of Nucleotides on HPLC Retention Time

As shown in the previous examples, the adaptation of the number of A nucleotides in RNA sequences allows for harmonization of HPLC chromatograms, which is a requirement for co-analysis and/or co-purification. The inventors further found that the number of A and/or U nucleotides correlates with HPLC retention time. That finding provides even more options for adapting an RNA sequence and to harmonize HPLC chromatograms of RNA mixtures. Further details are provided in the following.

5.1. Preparation of DNA Encoding HA Proteins of Several Influenza Strains:

DNA sequences encoding different haemagglutinin (HA) and neuraminidase (NA) proteins, two glycoproteins found on the surface of influenza viruses (Influenza A and Influenza B), were generated, and RNA was produced as described in Example 1.

TABLE 7

HA-constructs used in the experiment:

| Encoded antigen | SEQ ID NO: |
|---|---|
| HA-A California | 13 |
| HA-A Hongkong | 14 |
| HA-B Brisbane | 5 |
| HA-B Phuket | 9 |
| NA H1N1 (California) | 18 |
| NA H3N2 (Hongkong) | 16 |
| NA Influenza B (Brisbane) | 15 |

5.2. Correlation Between the Total Number of a Nucleotide and/or the Relative Content of a Nucleotide and the HPLC Retention Time:

HPLC sample preparation and HPLC analysis were performed as described Example 1.

In a first step, the individually produced RNA constructs (RNA species) encoding HA and NA antigens were separately analyzed on HPLC. The superimposed HPLC chromatograms are shown in FIG. 9. The superimposition of the chromatograms of the seven different RNA species showed that all chromatograms partially overlap, which makes both, co-purification and co-analysis via HPLC technically impossible (compare illustration of problem in the art, FIG. 1).

For a better understanding of the impact of the nucleotide sequence on HPLC retention time, the correlation between the nucleotide count (A, U, G, and C) and nucleotide content for each RNA molecule species and HPLC retention time was examined.

FIG. 10A shows the correlation between number and content (AU %) of A and U nucleotides of different HA and NA RNA species and their respective HPLC retention times. FIG. 10B shows the correlation between number and content (GC %) of guanine (G) and cytosine (C) nucleotides of different HA and NA RNA species and their respective HPLC retention times.

Results:

FIG. 10A shows a clear correlation of the number of A and/or U nucleotides with the respective retention time. Such a correlation was not found for the content of A and U nucleotides (AU %). FIG. 10B shows HPLC retention times are neither influenced by the number of G and/or C nucleotides, nor by the content of G and/or C nucleotides (GC %).

Notably, the correlation between the number of A nucleotides and the retention time is stronger than the correlation between the number of U nucleotides and the retention time; In line with that, the results of Example 4 also suggested that the effect of A nucleotides on retention time is stronger than the effect of U nucleotides on retention time.

Overall, the number of A and U nucleotides shows the best correlation and will allow for the most precise way for adapting RNA sequences to harmonize RNA mixtures for co-analysis and co-purification.

Example 6: Development of an Automated Nucleotide Adaptation Method (Algorithm)

The inventors developed an automated in silico method (algorithm) to set the number of any nucleotide in an RNA sequence to a certain defined value, without altering the amino acid sequence. In the context of the invention, the automated in silico method was used for sequence adaptation (adaptation of the number of A and/or U nucleotides (AU count)) of RNA sequences to allow harmonization of RNA mixtures for HPLC co-analysis and/or HPLC co-purification. Further details are provided in the following.

6.1 Sequence Analysis and Definition of Target AU Count:

The objective of the experiment was to generate RNA sequences for an adapted RNA mixture (comprising three different RNA molecule species encoding antibodies) suitable for co-analysis using HPLC. The AU count has to be adapted in all RNA molecule such that their respective HPLC chromatograms are completely separated (difference in the AU count of at least 70), allowing for co-analysis of their integrity.

Three antibody sequences (SEQ ID NOs: 20-22) were selected and GC optimized DNA (SEQ ID NOs: 23-25) sequences were generated (essentially according to Example 1). Nucleotide numbers were determined for the respective GC optimized sequences (product 1, product 2, product 3; see Table 8 below) to be able to define optimal numbers of A and U (T) nucleotides for HPLC co-analysis.

TABLE 8

Nucleotide numbers for GC optimized constructs:

| product | Length | A count | T (U) count | AT (AU) count | SEQ ID NO: |
|---|---|---|---|---|---|
| 1 | 81 | 19 | 13 | 32 | 23 |
| 2 | 258 | 59 | 26 | 85 | 24 |
| 3 | 429 | 77 | 55 | 132 | 25 |

To adapt the RNA molecule species comprised in the RNA mixture for HPLC co-analysis, the target AU counts for product 2 and product 3 were set to the following values, allowing integrity analysis on HPLC when analyzed as an RNA mixture:

TABLE 9

Adaptation strategy for co-analysis of the RNA mixture:

| product | AT (AU) count (non-adapted) | Change in AU count | Target AT (AU) count |
|---|---|---|---|
| 1 | 32 | 0 | 32 |
| 2 | 85 | +17 | 102 |
| 3 | 132 | +40 | 172 |

Figure 11:
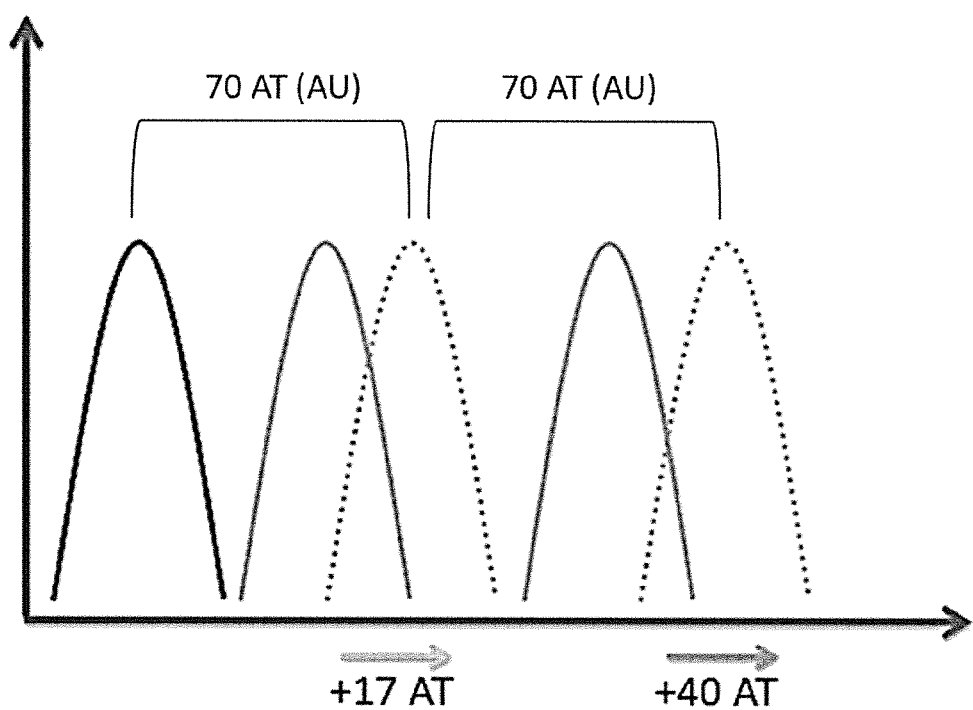
Figure 12:
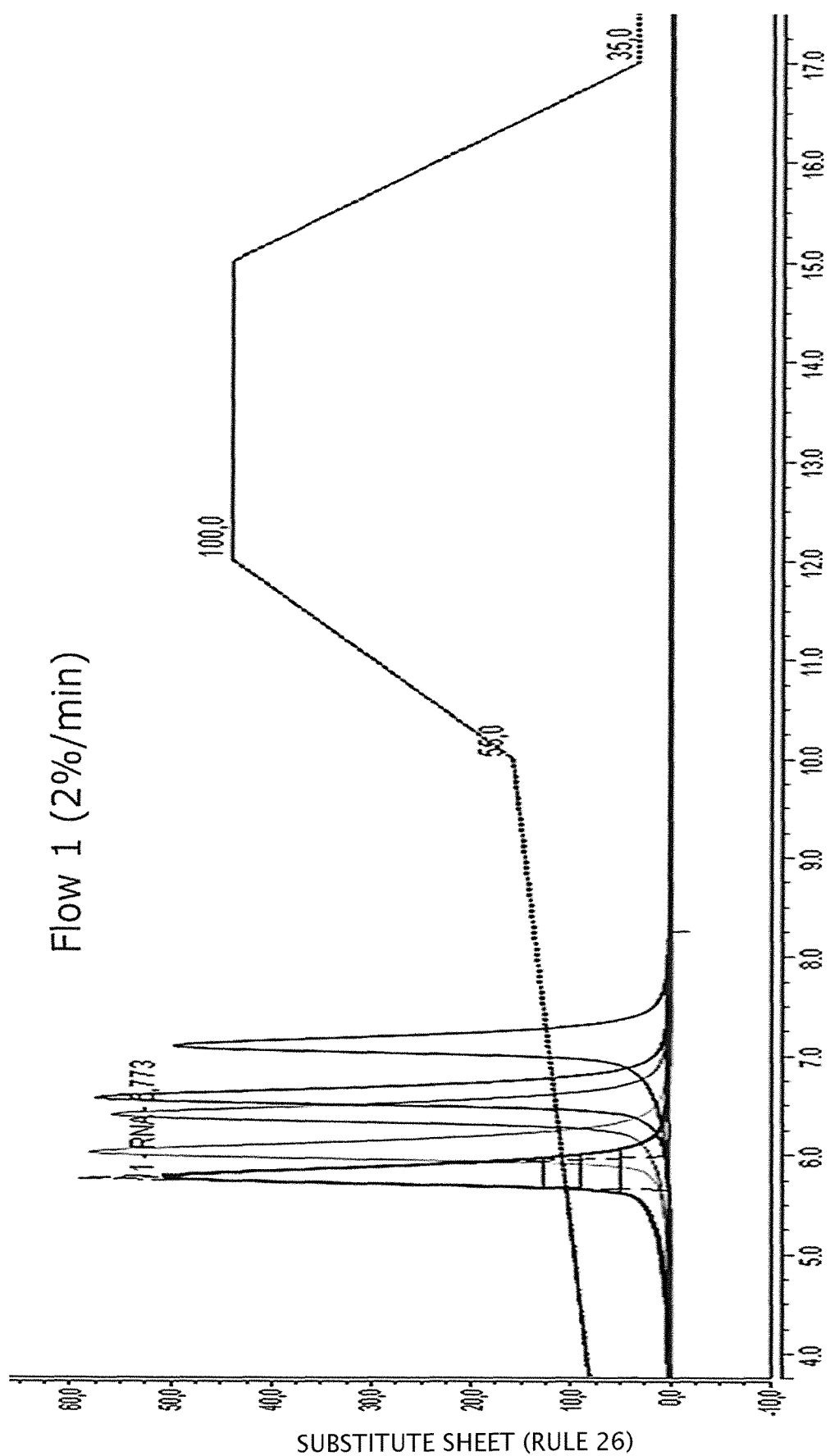
Figure 12:
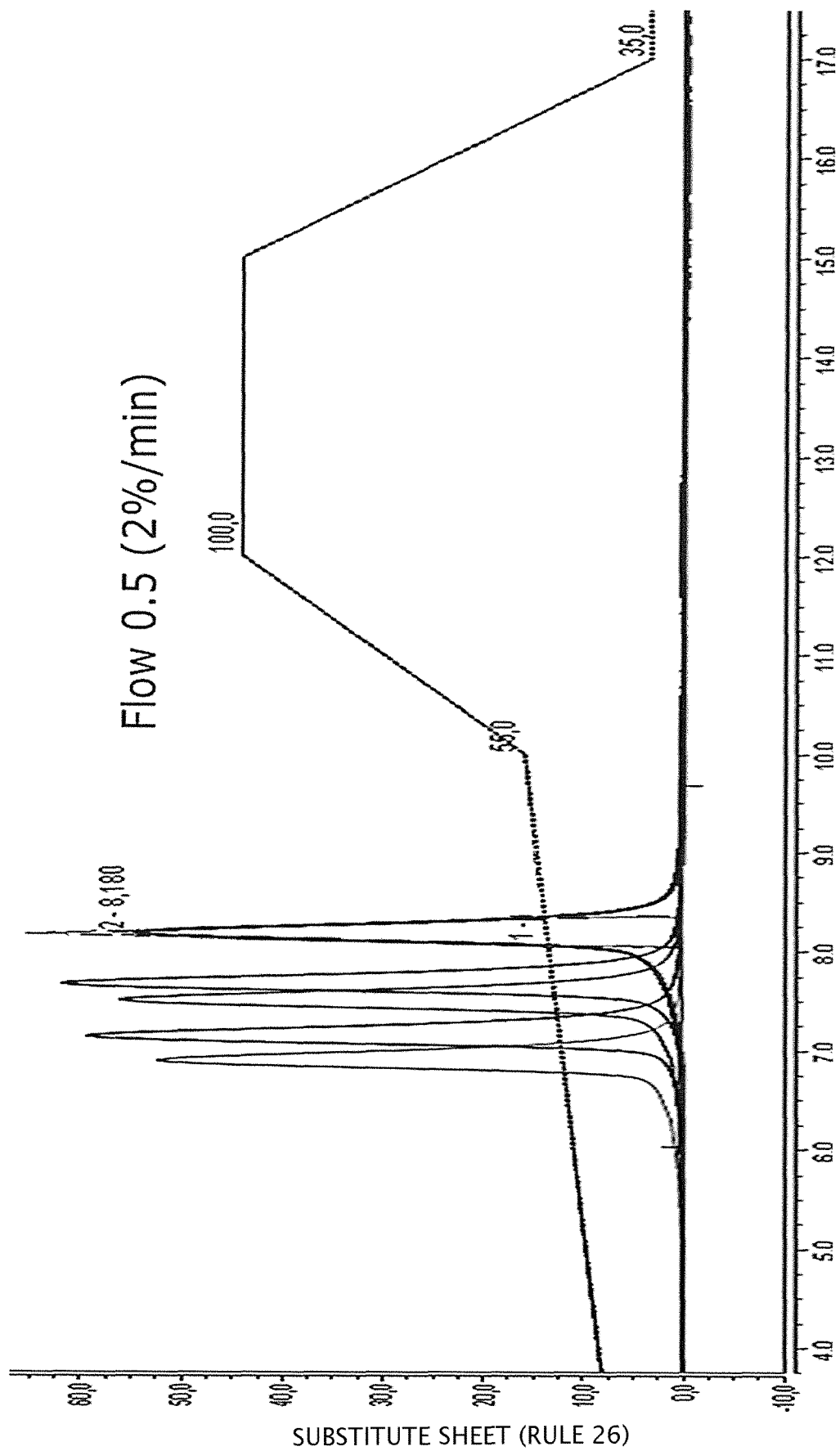

As indicated in Table 9, the target AU count for each product RNA was set in such a manner that the AU counts of the three RNA sequences differ by at least 70 nucleotides (strategy illustrated in FIG. 11).

6.2 AU Sequence Adaptation Method:

In the following, the sequence adaptation method is exemplarily described for product 2 (+17 AU) (SEQ ID NO: 24). As the number of A nucleotides in the sequence was larger than the number of T (U) nucleotides, the adaptation values were set to +8A and +9T(U) in order to maintain the distribution of A and U nucleotides in the resulting AU adapted sequence.

In the initial phase of the method (algorithm), a matrix for each codon comprised in the sequence was created, identifying possible changes (herein referred to as "exchange matrix"). An exemplary "exchange matrix" is shown in Formula (I).

$$\left.\begin{array}{cc} A & 1 \\ C & 1 \\ G & 1 \\ T & 1 \\ * & 4 \end{array}\right\} CGA \qquad \text{Formula (I)}$$

Formula (I) shows that for codon "CGA" a change to an alternative codon offers the option of increasing the number of A nucleotides by 1 (e.g.: CGA→AGA), offers the option of increasing the number of C nucleotides by 1 (e.g. CGA→CGC), offers the option of increasing the number of G nucleotides by 1 (e.g. CGA→CGG), and offers the option of increasing the number of T nucleotides by 1 (e.g. CGA→CGT).

Exchange matrices were generated for each individual codon in the sequence. Using said exchange matrices, the potential maximum number of the respective nucleotides (A and T(U) count, respectively) in each codon was determined (without changing the amino acid sequence). Accordingly, all 63 codons of the sequence were analyzed, and the potential alternative codons were assembled in a table structure as shown in Table 10 by way of example.

TABLE 10

Exemplary table of alternative
codons allowing for a change
in the number of a nucleotide

| Codons | Alternative codons |
|---|---|
| CGA | CGT, CGC, CGG, AGA, AGG |
| GAT | GAC |
| GAC | GAT |
| ATG | no alternative codon |
| ... | ... |

Next, the sequence according to SEQ ID NO: 24 was iteratively divided into separate codons and stored in table format, which resulted in a list as exemplarily shown in Table 11 (positions 1, 2, 3, 4 . . . 86 and 87 of the sequence are indicated).

TABLE 11

Codon list of
SEQ ID NO 24:

| Codon position | Codon |
|---|---|
| 1 | ATG |
| 2 | AGC |
| 3 | ATC |
| 4 | ATC |
| ... | ... |
| 86 | GAG |
| 87 | AGC |

Next, the list of codons (see Table 11) was analysed for possible codon changes by step-wise iteration, wherein in each iteration step the corresponding codon was analysed using the respective exchange matrix (as outlined above) for potential nucleotide changes. For example, if no changes were theoretically possible in the respective codon, e.g. as in the case of "ATG" or "TGG", the corresponding exchange matrix as exemplarily shown in Formula (II) was used (* of exchange matrix=0).

$$\begin{pmatrix} A & 0 \\ C & 0 \\ G & 0 \\ T & 0 \\ * & 0 \end{pmatrix} ATG \qquad \text{Formula (II)}$$

Formula (II) shows that for codon "ATG" a change to an alternative codon offers no option of increasing the number of A nucleotides, C nucleotides, G nucleotides or T nucleotides (as there are no alternative codons for ATG (Met)).

In cases where changes according to the respective exchange matrix (*>0) were theoretically possible, the codon was further analysed if these changes can be implemented under the premise that e.g. only codons that offer the option of increasing the number of A and/or T(U) nucleotides were adapted. Therefore the intersection between the target nucleotides (e.g. A and/or T(U)) and the nucleotides that potentially generate a positive result (that is, A and/or T(U) change; see e.g. Formula (I)) in the current exchange matrix was constructed. As a result, each codon was categorized and grouped in three categories:

Category 1 (Category "Favourable"):
Potential codon exchanges allowing an increase in only one target nucleotide (in the present example A or T(U)). For example, the codon "GAC" (Asp) can be changed to "GAU" (Asp) in order to increase the number of A and T(U) nucleotides. No further analysis is required since that modification does not have any further impact (besides the one mentioned above) on the number of A and T(U) nucleotides.

Category 2 (Category "Possible"):
Potential codon exchanges allowing the increase in both target nucleotides (in the present example A and T(U)). For example, codon "GCA" can be changed to "GCU", which would increase the T(U) count but at the same time decrease the A count. Accordingly, further analysis would be required with respect to codons belonging to this the category in order to decide, whether the number of one of the two target nucleotides (T(U)) in this example should be increased at the expense of a reduction of the number of the other target nucleotide (A).

Category 3 (Category "Impossible"):
Codons in the RNA sequence, for which no alternative codons exist (*=0). Examples for this category 3 are ATG (Met; start codon) or "UGG" (Trp).

All codons of the original sequence were categorized in that manner. After this step, there were three categories with a total of 87 entries (for 87 codons present in SEQ ID NO: 24). For the next step, category 3 was no longer considered, as a codon change will not influence the target nucleotide count (A, T(U)).

Next, it was calculated how many potential nucleotide changes have been identified for all target nucleotides (A, T(U)). For the SEQ ID NO: 24 the possible nucleotide changes are listed (category 1, category 2; see Table 12).

TABLE 12

Nucleotide changes that can potentially
be applied to SEQ ID NO 24

| Nucleotide | Potential changes | Category |
|---|---|---|
| A | 22 | 1 |
| T | 15 | 1 |
| A, T | 47 | 2 |

Accordingly, 22 favourable changes (see category 1/"favourable" as explained above) were identified for A and 15 favourable changes were identified for T(U). As the adaptation values were set to +8A and +9T(U) the adaptation at codon positions were all taken from category 1. Table 13 summarizes the introduced codon exchanges that were equally distributed across the sequence.

TABLE 13

Codon exchanges introduced into SEQ ID NO 24

| Position A | Exchange | increase | Position T | Exchange | increase |
|---|---|---|---|---|---|
| 30 | AAG -> AAA | +1 | 3 | AGC -> AGT | +1 |
| 48 | AAG -> AAA | +1 | 12 | AGC -> AGT | +1 |
| 78 | AAG -> AAA | +1 | 63 | GAC -> GAT | +1 |
| 141 | CAG -> CAA | +1 | 90 | AGC -> AGT | +1 |
| 165 | GAG -> GAA | +1 | 102 | AGC -> AGT | +1 |
| 213 | GAG -> GAA | +1 | 117 | AAC -> AAT | +1 |
| 234 | GAG -> GAA | +1 | 138 | AGC -> AGT | +1 |
| 252 | GAG -> GAA | +1 | 150 | AAC -> AAT | +1 |
|  |  |  | 180 | AGC -> AGT | +1 |

These exchanges resulted in the following adapted sequence according to SEQ ID NO: 25.

In the above described example, potential nucleotide exchanges from category 2 were not implemented. However, in scenarios where e.g. T(U) counts larger than 15 are needed, codons from category 2 are used as soon as all codons from category 1 have been used, in order to obtain additional adaptation possibilities for A and T(U) counts. If category 2 is required in order to achieve the desired nucleotide counts, calculation of the following ratio will identify the exchange nucleotide (nucleotide A or T(U)):

$$\frac{c_i}{x_i - p_i}$$

wherein i represents the corresponding target, $c_i$ is the count of possible adaptation positions of i in category 2, $x_i$ is the desired threshold for i, $p_i$ the count for the already changed identified adaptation positions. All calculated ratios are ranked and starting from lowest to highest ratio, the changes from category 2 are applied, until the desired threshold has been reached or until all the possible exchanges from category 2 have been performed. This procedure is carried out iteratively for all targets, where the desired numbers cannot be achieved by only using exchanges according to category 1.

For example, category 2 contains 47 codons (see Table 12), which could potentially be exchanged in order to increase the A or T count. Accordingly, further changes are implemented from category 2 until the desired threshold has been reached or until all the codons from category 2 have been used as well. For SEQ ID NO: 24, a change of the T(U) count to e.g. 20 would result in additional adaptations by using the following alternative codons from category 2 (additional codon exchanges from category 1 are not shown): 6=ATT, 9=ATT, 21=CTT, 144=CCT, 183=TCT.

In cases where the desired target nucleotide count cannot be achieved (as all alternative codons from category 1 and 2 have been used, which means that no further changes are possible), an adapted sequence is generated that is matching the target nucleotide count as close as possible.

In order to further optimize the above described method (algorithm), the following improvements are implemented:
1. The basic equal distribution, which was used in the experiments described above, is based on the exchange possibilities. Other distribution models may also be envisaged, such as normal distribution, first occurrences distribution, last occurrences distribution or random-based distribution. Alternatively, the mean of the possible changes or median of the possible changes may be determined and all exchanges may be arranged around these values.
2. The exchange matrix contains additional information about the codon for the target sequence (e.g. codon usage etc.). This creates a further criteria for the question of whether a codon exchange is desirable or not, facilitating adaptation to a specific codon usage or a different nucleotide ratio in the target sequence.
3. Implementation of a third category by sequences or motifs which should be avoided by an exchange (e.g. a recognition motif of a restriction enzyme, promotor sequences or sequences building not desired secondary structures, etc.).
4. Automated binning of input sequences, based on their length and the occurrence of the desired target nucleotides in order to identify optimal nucleotide counts for A and/or U adaptation.

Example 7: Generation and Use of a Polyvalent Influenza Virus RNA Platform for Fast-Adjustable Influenza Vaccine Production A pool of GC optimized coding sequences encoding HA antigens were AU adapted to a count of 612 AU (360 A and 252 T) resulting in an AU adapted HA sequence pool (SEQ ID NO: 26 to 16263). A pool of GC optimized coding sequences encoding NA antigens were AU adapted to an AU count of 488 AU (271A and 217U) resulting in an AU adapted NA sequence pool (SEQ ID NOs: 16264-30567). AU adaptations were performed according to the invention, essentially as described in Example 6. The adaptation allows co-purification of RNA mixtures comprising adapted HA RNA sequences and co-purification of RNA mixtures comprising adapted NA sequences. Moreover the adaptation allows co-analysis of an RNA mixture comprising adapted HA and NA RNA species as the RNA sequences encoding HA (AU count 612) and the RNA sequences encoding NA (AU count 488) generate separated peaks (AU count difference: 124), suitable for analysis of integrity using HPLC.

HA RNA mixtures are produced according to procedures as disclosed in the PCT application WO2017/109134 using GC optimized AT adapted DNA templates (generated as described in Example 1). In short, a DNA construct mixture (each of which comprising different HA coding sequences and a T7 promotor) is used as a template for simultaneous RNA in vitro transcription to generate a mixture of HA mRNA constructs. Subsequently, the obtained harmonized RNA mixture is used for co-purification using RP-HPLC.

In a parallel reaction, NA RNA mixtures are produced according to procedures as disclosed in the PCT application WO 2017/109134 using GC optimized AT adapted DNA templates. In short, a DNA construct mixture (each of which comprising different NA coding sequences and a T7 promotor) is used as a template for simultaneous RNA in vitro transcription to generate a mixture of HA mRNA constructs. Subsequently, the obtained harmonized RNA mixture is used for co-purification using RP-HPLC.

The purified mRNA mixture encoding HA antigens and the purified mRNA mixture encoding NA antigens are mixed to generate a HA/NA RNA mixture. The integrity of the mixture (that is of the NA peak and the HA peak) is co-analyzed via HPLC as described herein.

Advantageously, the AU adaptation of HA sequences and NA sequences in order to harmonize chromatographic peaks for HPLC based co-purification and co-analysis according to the invention facilitates the production of mRNA-based multivalent influenza vaccines, which may be quickly adapted to demand, e.g. in seasonal influenza vaccine design or in a pandemic scenario (compare with FIG. 3).

Example 8: Suitability of the Method on Various Reverse Phase HPLC Matrices

The inventors found that modification of the retention time of an RNA via adaptation of A and/or U count is not restricted to a certain reverse phase column chemistry.

To test whether a modification in retention time via an adaptation of A and/or U count can also be observed on other reverse phase columns (in Example 1-7, a monolithic poly (styrene-divinylbenzene)matrix has been used), the following columns were tested:
- monolithic ethylvinylbenzene-divinylbenzene copolymer (ThermoFisher Scientific) (see FIG. 13)
- particulate poly(styrene)-divinylbenzene column (ThermoFisher Scientific) (see FIG. 14)
- Silica-based C4 column (ThermoFisher Scientific) (see FIG. 15)
- PLRPS, non-alkylated porous poly(styrene-divinylbenzene)matrix(see FIG. 16)

RNA encoding yellow fever virus antigens was generated. The constructs encode the same antigen (YFV(17D)-prME), comprise the same UTR elements, and have the same size. The AU count for each constructs was changed via coding-sequence adaptation. The constructs are listed in Table 14.

TABLE 14

AU adapted YFV constructs

| SEQ ID NO | Antigen | RNA size | A | U | G | C | AU | GC |
|---|---|---|---|---|---|---|---|---|
| 30588 | prME | 2311 | 474 | 350 | 544 | 943 | 824 | 1487 |
| 30589 | prME | 2311 | 587 | 307 | 704 | 713 | 894 | 1417 |
| 30590 | prME | 2311 | 633 | 504 | 627 | 547 | 1137 | 1174 |
| 30591 | prME | 2311 | 788 | 351 | 555 | 617 | 1139 | 1172 |
| 30592 | prME | 2311 | 886 | 538 | 516 | 371 | 1424 | 887 |

To evaluate the effect of AU adaptation on retention time, 500 ug of each construct was subjected individually to the respective column. In addition, for each column two different flow-rates were tested. Results are shown in FIGS. 12-15.

Figure 16:
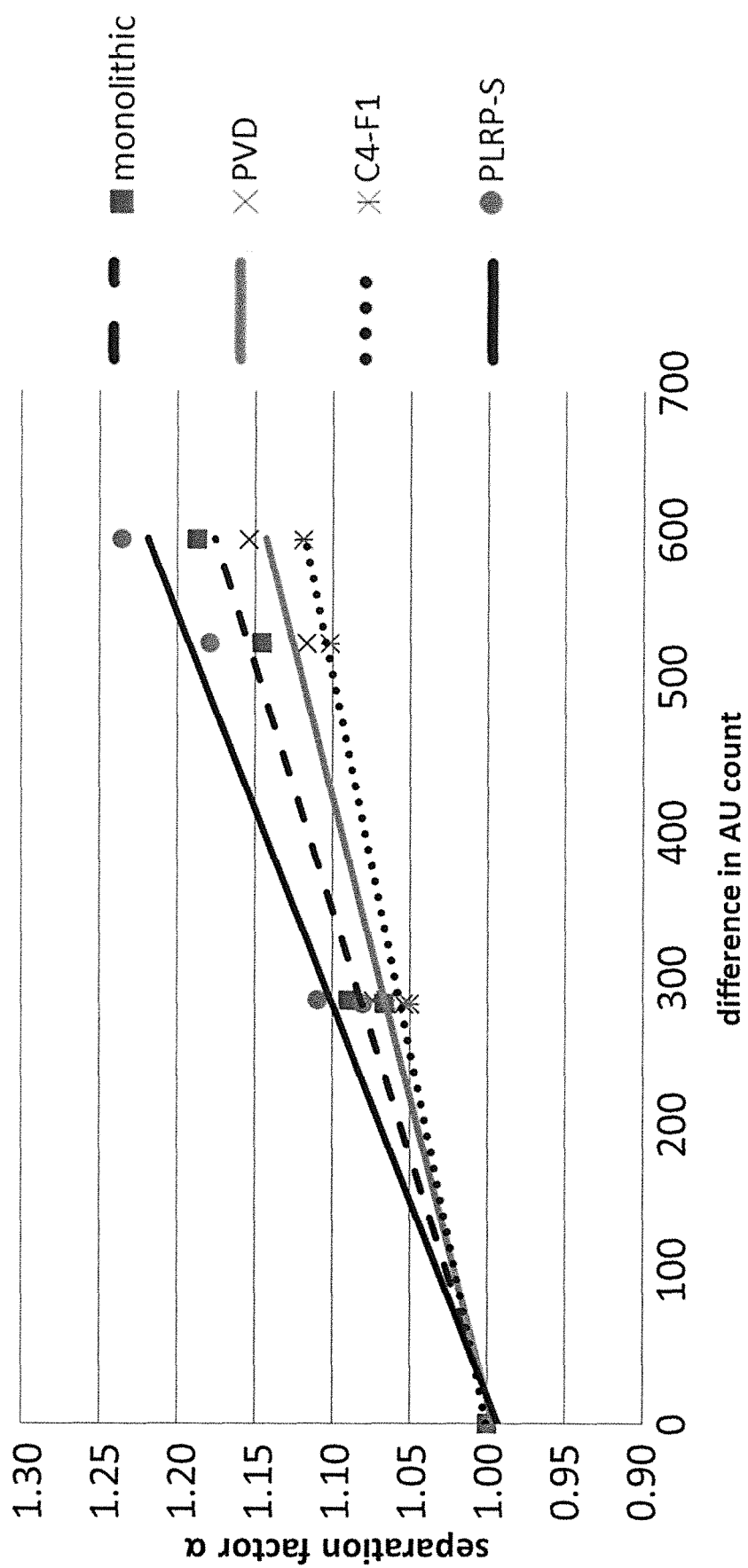

In addition, the separation factor alpha was determined for each construct on each column tested. In chromatography, the separation factor alpha expresses the ratio of retention times of two compounds. Accordingly, a separation factor of value of larger 1.0 means that separation of two compounds occurred. In the present analysis, SEQ ID NO: 30592 (with AU 1424) was taken as a reference for separation factor calculation. The calculated separation factors are shown in Table 15. The obtained separation factor values were plotted against the AU count difference of the constructs (SEQ ID NO: 30592, with AU 1424 was taken as a reference). The diagram is shown in FIG. 16.

TABLE 15

AU adapted YFV constructs

| SEQ ID NO | RNA size | AU count | AU difference | Alpha monolithic | Alpha PVD | Alpha C4 | Alpha PLPR-S |
|---|---|---|---|---|---|---|---|
| 30592 | 2311 | 1424 | 0 | 1,00 | 1,00 | 1,00 | 1,00 |
| 30591 | 2311 | 1139 | 285 | 1,07 | 1,05 | 1,05 | 1,08 |
| 30590 | 2311 | 1137 | 287 | 1,09 | 1,07 | 1,06 | 1,11 |
| 30589 | 2311 | 894 | 530 | 1,15 | 1,12 | 1,10 | 1,18 |
| 30588 | 2311 | 824 | 600 | 1,19 | 1,15 | 1,12 | 1,24 |

CONCLUSION

Figure 13:
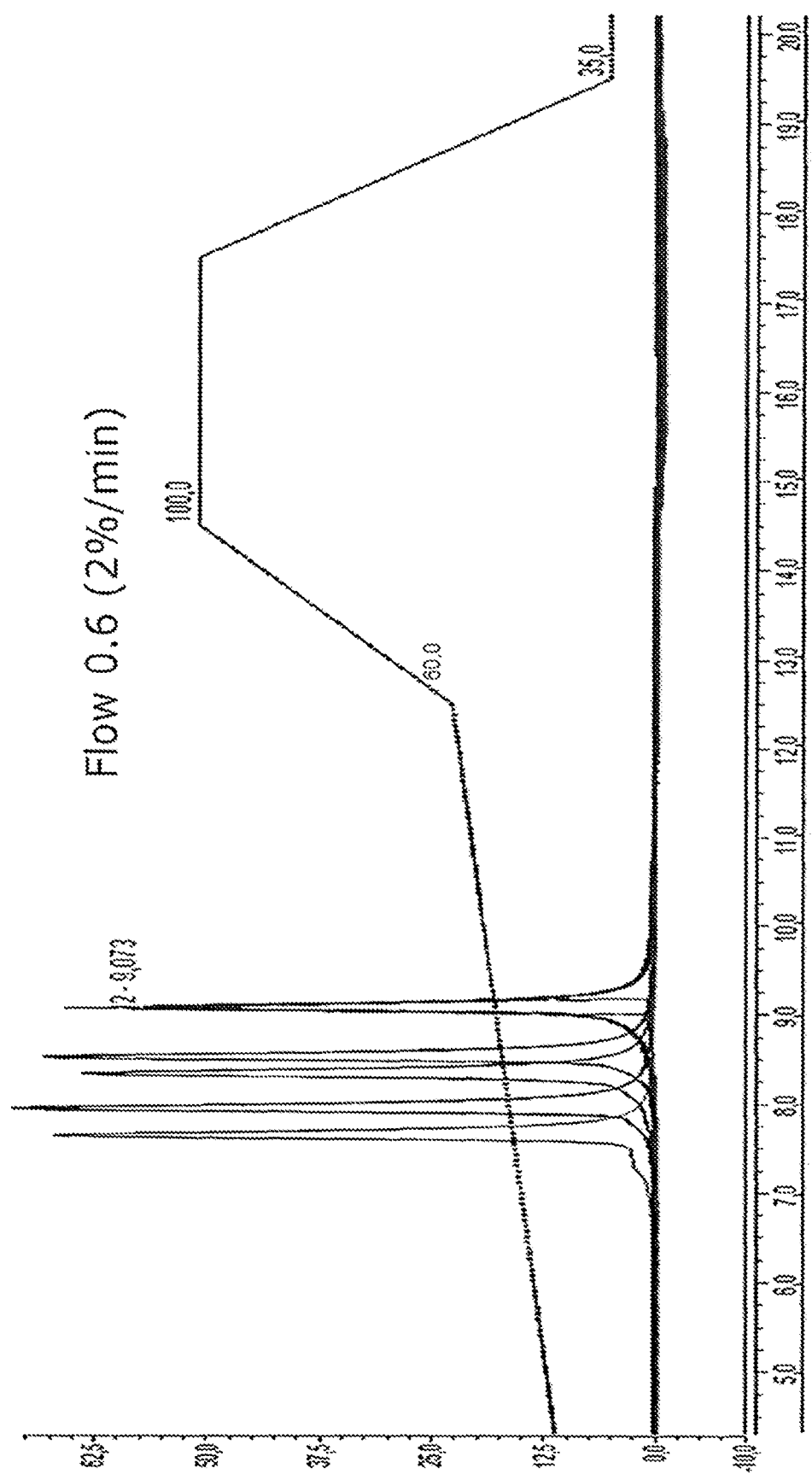
Figure 13:
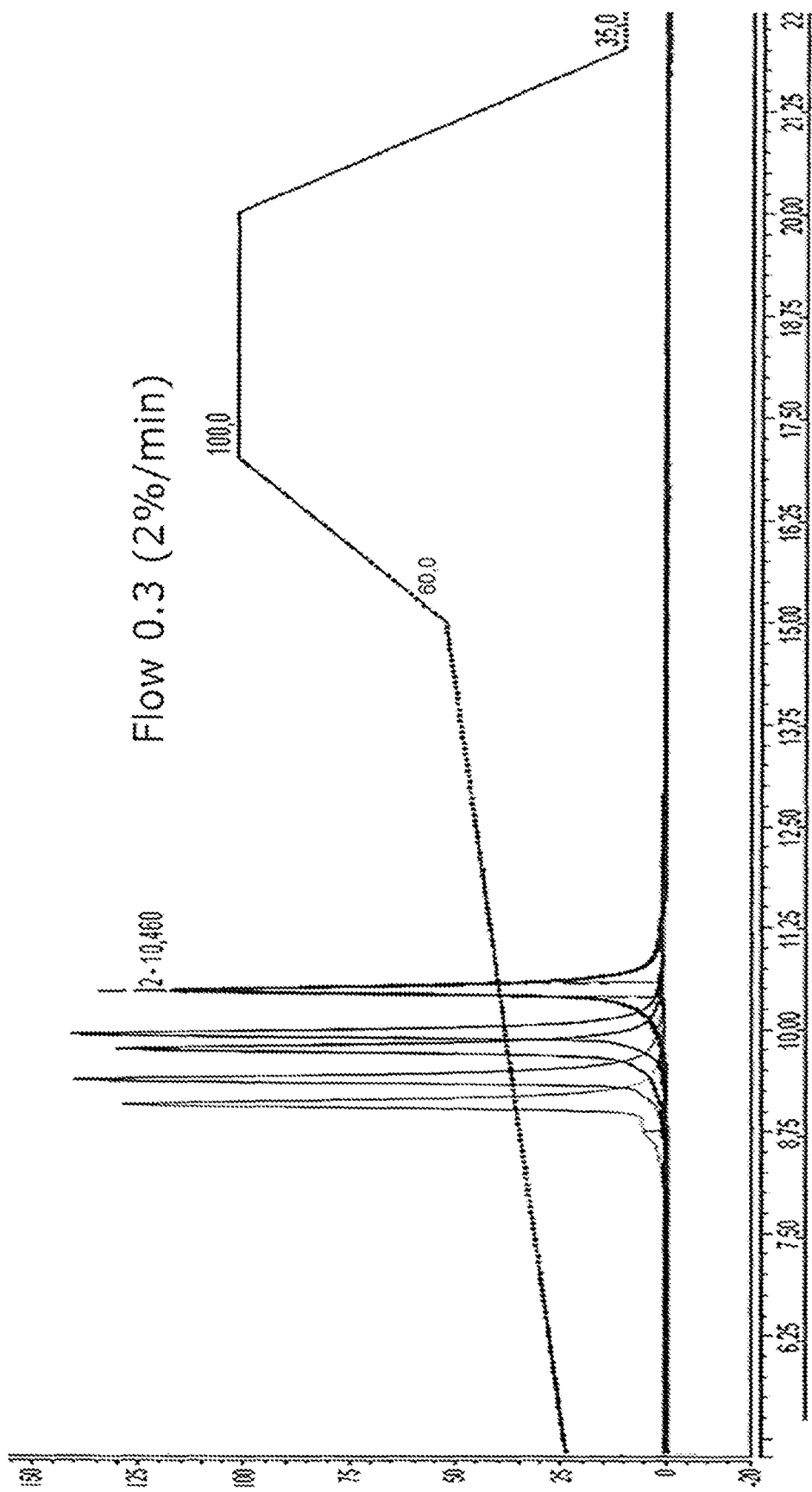

As shown in FIG. 13, the modulation of retention time works on a monolithic ethylvinylbenzene-divinylbenzene-copolymer. All four constructs elute at different retention times and could be clearly separated. In the present case, the separation of construct with AU824 from the construct with AU894 was strong enough to allow further analysis of the peaks.

Figure 14:
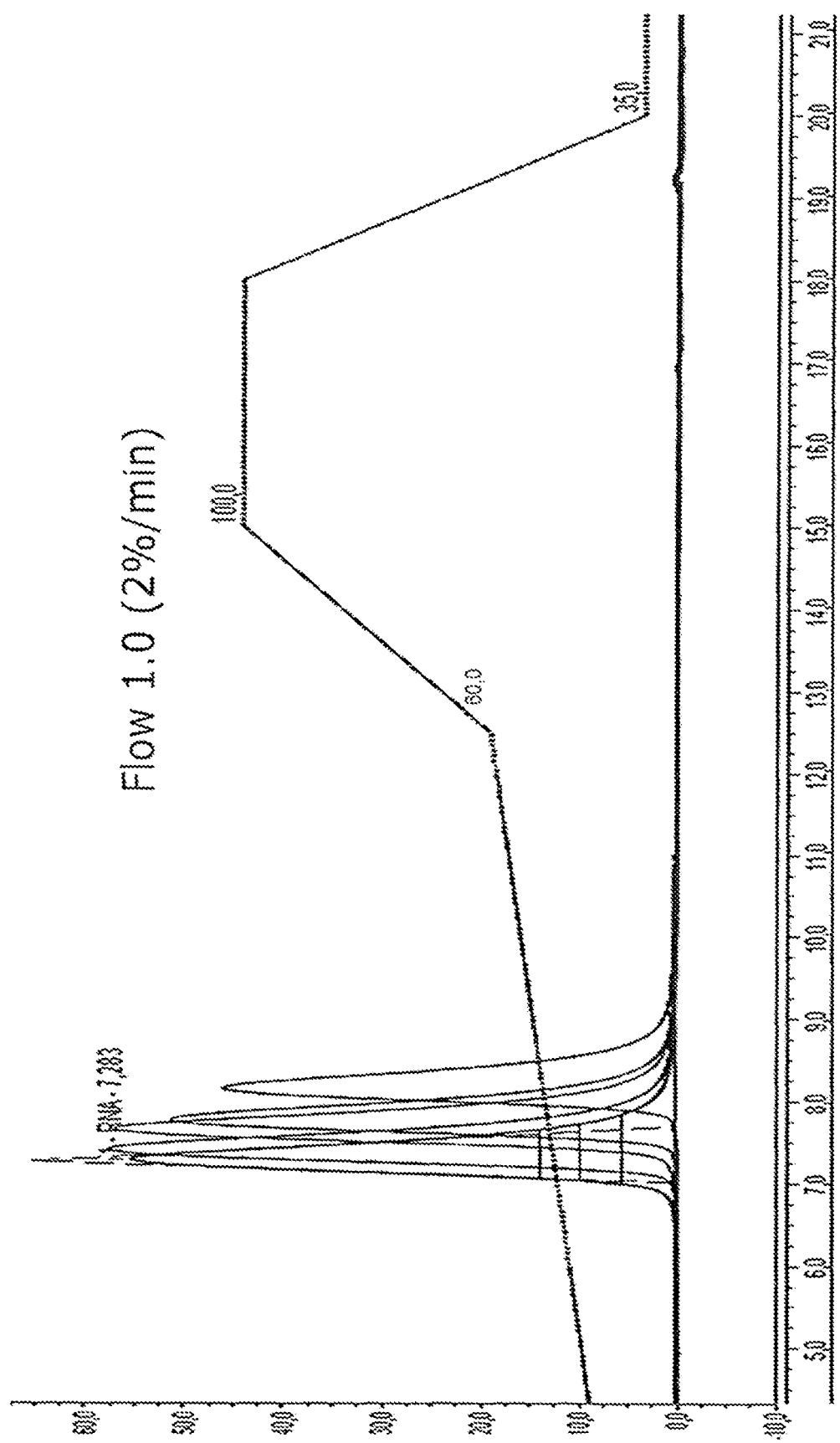
FIG. 14; PLPR-S: Values and respective trend line for PLPR-S column with flowrate 1.0, cf.
Figure 14:
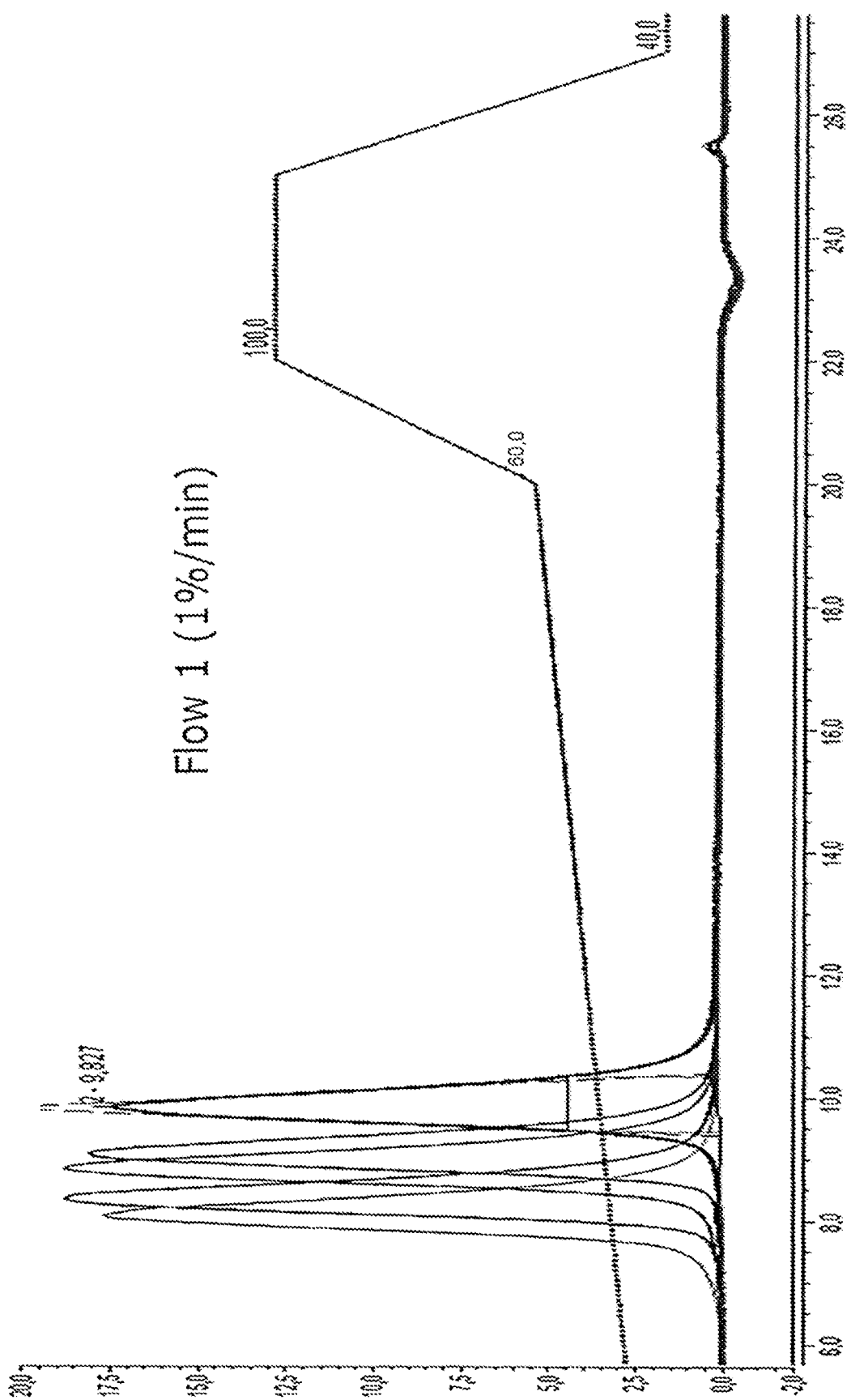

As shown in FIG. 14, the modulation of retention time works on a particulate poly(styrene)-divinylbenzene column. All four constructs elute at different retention times and could be clearly separated. In the present case, the separation of construct with AU824 from the construct with AU894 was strong enough to allow further analysis of the peaks.

Figure 15:
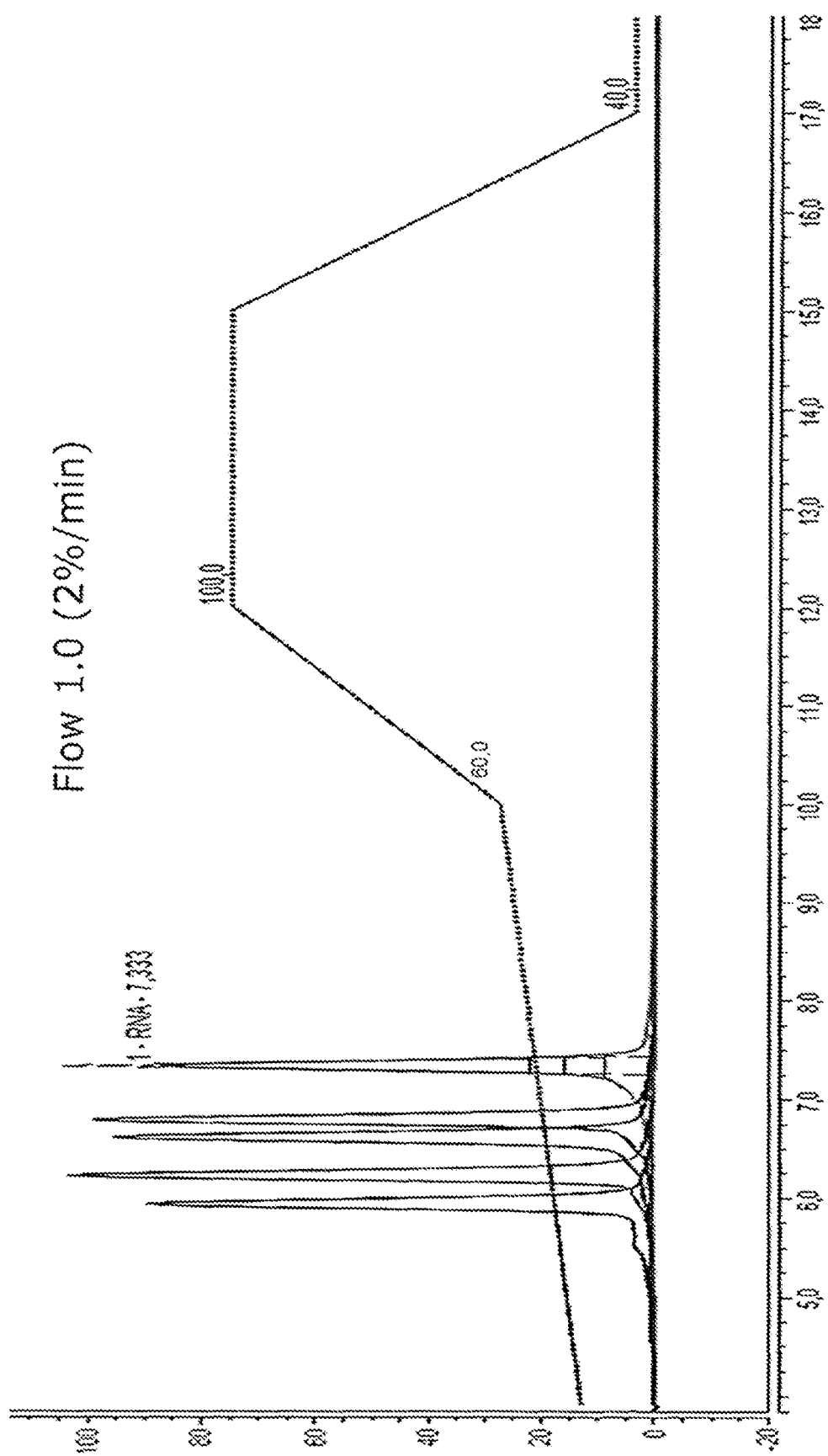
FIG. 15. A detailed description of the experiment is provided in Example 8.
Figure 15:
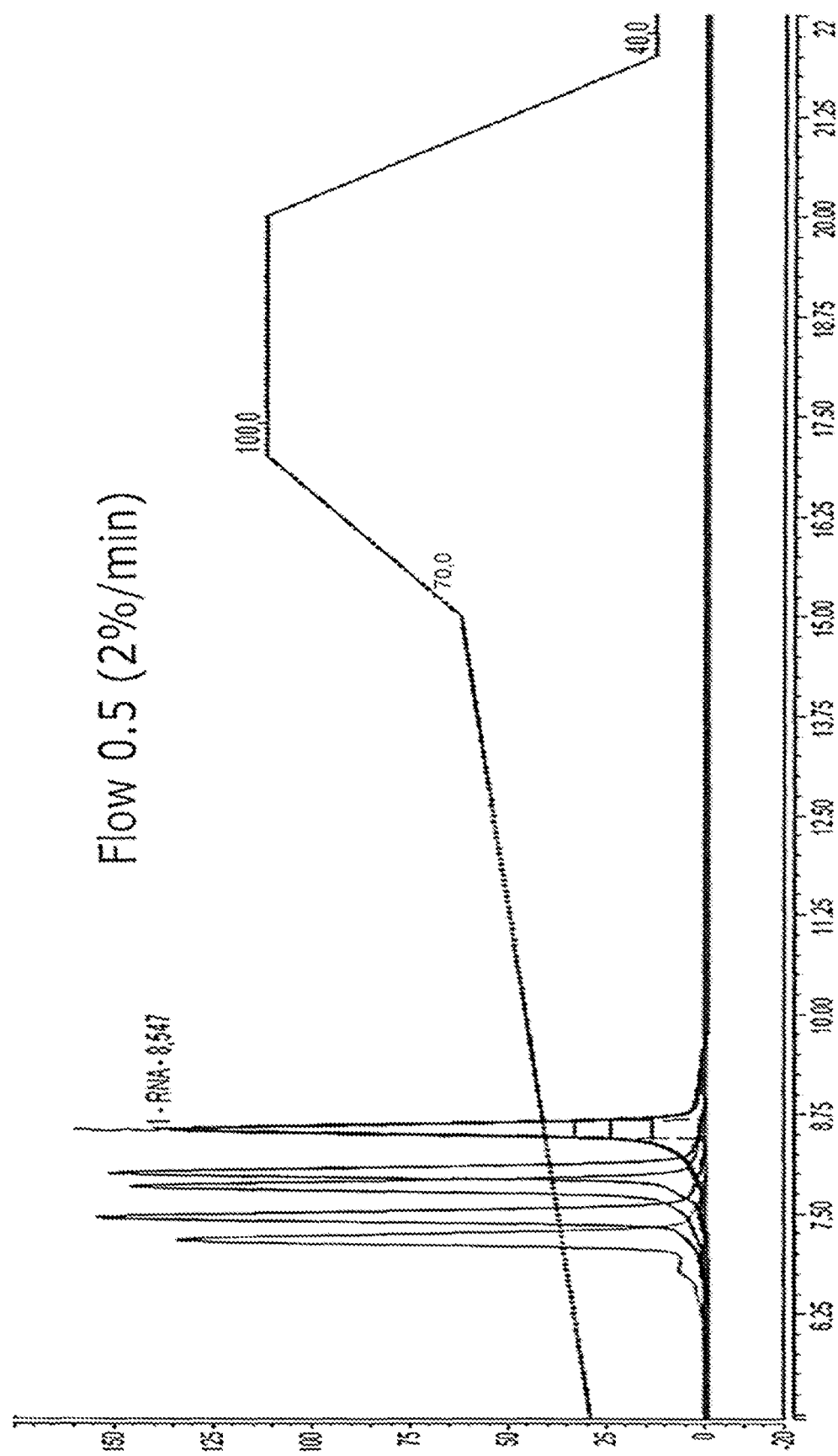

As shown in FIG. 15, the modulation of retention time works on a Silica-based C4 column. All four constructs elute at different retention times and could be clearly separated. In the present case, the separation of construct with AU824 from the construct with AU1139 was strong enough to allow further analysis of the peaks.

FIG. 16 summarizes the inventive concept of the present invention. An adaption of the AU count of the different RNA constructs (in other words: increasing the difference in AU count between the constructs) led to a modification in retention time, thereby allowing a separation on HPLC. Notably, that effect was observed irrespective of the column matrix used.

Of course, a harmonization of AU counts (in other words: decreasing the difference in AU count between the constructs) would also lead to a modification in retention time, thereby allowing co-purification on HPLC.

SEQUENCE LISTING (30592 sequences)

SEQ ID NO: 1 - RNA, 1831 nt, Artificial Sequence
  mRNA product from modified/optimized luciferase (A25), PpLuc, R3510
gggagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguuauaagacugacuagcccgaugggccucccaacgggcccuccuccccuccuugcaccgagauuaauaaaaaaaaaaaaaaaaaaaaaaaaaugcaucccccccccccccccccccccccccccccccaaaggcucuuuucagagccaccagaauu

SEQ ID NO: 2 - RNA, 1841 nt, Artificial Sequence
  mRNA product from modified/optimized luciferase (A35), PpLuc, R3508
gggagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguuauaagacugacuagcccgaugggccucccaacgggcccuccuccccuccuugcaccgagauuaauaaaaaaaaaaaaaaaaaaaaaaaaaaaaaaaaaaaugcaucccccccccccccccccccccccccccccccaaaggcucuuuucagagccaccagaauu

SEQ ID NO: 3 - RNA, 1856 nt, Artificial Sequence
  mRNA product from modified/optimized luciferase (A50), PpLuc, R3500
gggagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4 - RNA, 1870 nt, Artificial Sequence
  mRNA product from modified/optimized luciferase (A64), PpLuc, R2988
gggagaaagcuuaccauggaggacgccaagaacaucaagaagggcccggcgcccuucuacccgcuggaggacgggaccgccggcgagcagcuccacaaggccaugaagcgguacgcccuggugccgggcacgaucgccuucaccgacgcccacaucgaggucgacaucaccuacgcggaguacuucgagaugagcgugcgccuggccgaggccaugaagcgguacggccugaacaccaaccaccggaucguggugugcucggagaacagccugcaguucuucaugccggugcugggcgcccucuucaucggcguggccgucgccccggcgaacgacaucuacaacgagcgggagcugcugaacagcauggggaucagccagccgaccgugguguucgugagcaagaagggccugcagaagauccugaacgugcagaagaagcugcccaucauccagaagaucaucaucauggacagcaagaccgacuaccagggcuuccagucgauguacacguucgugaccagccaccucccgccgggcuucaacgaguacgacuucgucccggagagcuucgaccgggacaagaccaucgcccugaucaugaacagcagcggcagcaccggccugccgaaggggguggcccugccgcaccggaccgccugcgugcgcuucucgcacgcccgggaccccaucuucggcaaccagaucaucccggacaccgccauccugagcguggugccguuccaccacggcuucggcauguucacgacccugggcuaccucaucugcggcuuccgggugguccugauguaccgguucgaggaggagcuguuccugcggagccugcaggacuacaagauccagagcgcgcugcucgugccgacccuguucagcuucuucgccaagagcacccugaucgacaaguacgaccugucgaaccugcacgagaucgccagcgggggcgccccgcugagcaaggaggugggcgaggccguggccaagcgguuccaccucccgggcauccgccagggcuacggccugaccgagaccacgagcgcgauccugaucacccccgagggggacgacaagccgggcgccgugggcaagguggucccguucuucgaggccaaggugguggaccuggacaccggcaagacccugggcgugaaccagcggggcgagcugugcgugcgggggccgaugaucaugagcggcuacgugaacaacccggaggccaccaacgcccucaucgacaaggacggcuggcugcacagcggcgacaucgccuacugggacgaggacgagcacuucuucaucgucgaccggcugaagucgcugaucaaguacaagggcuaccagguggcgccggccgagcuggagagcauccugcuccagcaccccaacaucuucgacgccggcguggccgggcugccggacgacgacgccggcgagcugccggccgcggugguggugcuggagcacggcaagaccaugacggagaaggagaucgucgacuacguggccagccaggugaccaccgccaagaagcugcggggcggcgugguguucguggacgaggucccgaagggccugaccgggaagcucgacgcccggaagauccgcgagauccugaucaaggccaagaagggcggcaagaucgccgugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5 - RNA, 1975 nt, Artificial Sequence
  mRNA product from modified/optimized HA-B Brisbane (467A,256U,AU723), InfluBV(Brisbane2008)-HA, R2361
gggagaaagcuuaccaugaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6 - RNA, 1975 nt, Artificial Sequence
  mRNA product from modified/optimized HA-B Brisbane (476A,256U,AU732), InfluBV(Brisbane2008)-HA, R5697
gggagaaagcuuaccaugaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagagccacuucgccaaccugaaagggacggagacccgcggcaagcucugccccaagugccugaacugcaccgaccuggacguggcccucgggcggcccaagugcaccggcaaaaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaaaaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaauccgggaagacgggcaccaucaccuaccagcggggcauccuccugccccagaagguguggugcgccagcgggcgcuccaaggucaucaaaggcagccugccccucaucggggaggccgacugccugcacgagaaguacggcgggcugaacaagagcaagcccuacuacaccggcgagcacgcgaaagccaucggcaacugcccgaucugggugaagacgccccucaagcuggccaacgggaccaaguaccggccccccgccaaacugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaaaaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaaacucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7 - RNA, 1984 nt, Artificial Sequence
  mRNA product from modified/optimized HA-B Brisbane (476A,256U,AU732), InfluBV(Brisbane2008)-HA, R5699
gggagaaagcuuaccaugaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8 - RNA, 1988 nt, Artificial Sequence
  mRNA product from modified/optimized HA-B Brisbane (476A,258U,AU734), InfluBV(Brisbane2008)-HA, R5701
gggagaaagcuuaccaugaaggccaucaucgugcugcucauggucgugaccagcaacgccgaccggaucugcaccggcaucacguccagcaacuccccgcacguggucaagaccgcgacccagggggaggugaacgugaccggcgucaucccgcugacgaccacccccaccaagagccacuucgccaaccugaaggggacggagacccgcggcaagcucugccccaagugccugaacugcaccgaccuggacguggcccucgggcggcccaagugcaccggcaagaucccguccgcccgcgugagcauccugcacgagguccggcccgugacguccggcugcuuccccaucaugcacgaccgcaccaagauccggcagcugcccaaccuccugcgcggguacgagcacauccggcugagcacccacaacgugaucaacgccgagaacgcgccgggcgggcccuacaagaucggcaccuccgggagcugccccaacaucacgaacggcaacggcuucuucgccaccauggccugggccguccccaagaacgacaagaacaagaccgcgaccaacccgcucacgaucgaggugcccuacaucugcaccgagggggaggaccagaucaccguguggggcuuccacuccgacaacgagacccagauggccaagcuguacggggacagcaagccccagaaguucacguccagcgccaacggcgucaccacccacuacgugucccagaucggcggguuccccaaccagaccgaggacggcgggcugccgcagagcggccgcaucguggucgacuacauggugcagaaguccgggaagacgggcaccaucaccuaccagcggggcauccuccugccccagaagguguggugcgccagcgggcgcuccaaggucaucaagggcagccugccccucaucggggaggccgacugccugcacgagaaguacggcgggcugaacaagagcaagcccuacuacaccggcgagcacgcgaaggccaucggcaacugcccgaucugggugaagacgccccucaagcuggccaacgggaccaaguaccggccccccgccaagcugcucaaggagcgcggcuucuucggggccaucgcgggcuuccuggagggcgggugggagggcaugaucgccggguggcacggcuacaccucccacggggcccacggcguggccgucgccgcggaccugaagagcacccaggaggccaucaacaagaucacgaagaaccucaacucccugagcgagcuggaggugaagaaccuccagcggcuguccggcgccauggacgagcugcacaacgagauccucgagcuggacgagaaggucgacgaccugcgcgccgacaccaucagcucccagaucgagcucgccgugcugcugagcaacgaggggaucaucaacuccgaggacgagcaccuccuggcgcuggagcggaagcucaagaagaugcugggcccgagcgccguggagaucgggaacggcugcuucgagaccaagcacaagugcaaccagaccugccuggaccgcaucgccgccgggaccuucgacgcgggcgaguucucccuccccacguucgacagccugaacaucaccgccgccucccugaacgacgacggccuggacaaccacaccauccuccuguacuacagcaccgccgccuccagccuggcggucacgcucaugaucgccaucuucgugguguacauggucucccgggacaacgugagcugcuccaucugccugugaggacuaguuauaagacugacuagcccgaugggccucccaacgggcccuccuccccuccuugcaccgagauuaauaaaaaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9 - RNA, 1972 nt, Artificial Sequence
  mRNA product from modified/optimized HA-B Phuket (458A,259U,AU717), InfluBV(Phuket-3073-2013)-HA, R4904
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10 - RNA, 1972 nt, Artificial Sequence
  mRNA product from modified/optimized HA-B Phuket (467A,259U,AU726), InfluBV(Phuket-3073-2013)-HA, R5698
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaaacucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaagccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaaaucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaaaguguggugcgccuccgggcgcagcaaggugaucaagggcagccucccccugaucggggaggcggacugccugcacgaggaguacggcgggcucaacaaguccaaaccguacuacaccggcaagcacgccaaggccaucgggaacugccccaucugggucaagaccccgcugaaacuggccaacggcacgaaauaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaaaaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaaacugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 11 - RNA, 1981 nt, Artificial Sequence
  mRNA product from modified/optimized HA-B Phuket (467A,259U,AU726), InfluBV(Phuket-3073-2013)-HA, R5700
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12 - RNA, 1985 nt, Artificial Sequence
  mRNA product from modified/optimized HA-B Phuket (467A,261U,AU728), InfluBV(Phuket-3073-2013)-HA, R5702
gggagaaagcuuaccaugaaggccaucaucgugcugcucauggucgugaccagcaacgccgaccgcaucugcaccggcaucacguccagcaacuccccgcacguggucaagaccgcgacccagggggaggugaacgugaccggcgucaucccccugacgaccacccccaccaagagcuacuucgccaaccugaaggggacgcggacccgcggcaagcucugccccgacugccugaacugcaccgaccuggacguggcccucgggcggcccaugugcgugggcaccacgccguccgccaaggccagcauccugcacgagguccgccccgugaccuccggcugcuuccccaucaugcacgaccggaccaagauccgccagcugcccaaccuccugcggggguacgagaagauccgccugagcacccagaacgugaucgacgcggagaaggccccgggcgggcccuaccggcucggcacguccgggagcugccccaacgccaccuccaagaucggcuucuucgccaccauggcgugggccguccccaaggacaacuacaagaacgccaccaacccgcugacgguggaggugcccuacaucugcaccgagggcgaggaccagaucaccgucuggggguuccacagcgacaacaagacccagaugaagucccuguacggcgacagcaacccccagaaguucacguccagcgccaacggggugaccacccacuacgugucccagaucggcgacuuccccgaccagaccgaggacggcgggcucccgcagagcggccgcaucgucguggacuacaugaugcagaagcccgggaagacgggcaccaucguguaccagcggggcguccugcugccccagaagguguggugcgccuccgggcgcagcaaggugaucaagggcagccucccccugaucggggaggcggacugccugcacgaggaguacggcgggcucaacaaguccaagccguacuacaccggcaagcacgccaaggccaucgggaacugccccaucugggucaagaccccgcugaagcuggccaacggcacgaaguaccggcccccggccaagcuccugaaggagcgcggcuucuucggggcgaucgccggcuuccuggagggcgggugggaggggaugaucgccggcuggcacggcuacaccagccacggggcccacggcguggccgucgcggccgaccucaaguccacccaggaggccaucaacaagaucaccaagaaccugaacagccuguccgagcucgaggugaagaaccugcagcggcugagcggggccauggacgagcuccacaacgagauccuggagcuggacgagaagguggacgaccuccgcgccgacacgaucuccagccagaucgagcuggcgguccugcucuccaacgagggcaucaucaacagcgaggacgagcaccuccuggcccucgagcggaagcugaagaagaugcugggccccuccgccguggacaucgggaacggcugcuucgagaccaagcacaagugcaaccagaccugccucgaccgcaucgccgcggggaccuucaacgccggcgaguucagccugcccaccuucgacucccugaacaucacggccgccagccugaacgacgacgggcucgacaaccacaccauccugcuguacuacuccaccgccgcgagcucccucgccgugacccugaugcuggccaucuucaucgucuacauggugagccgggacaacguguccugcagcaucugccucugaggacuaguuauaagacugacuagcccgaugggccucccaacgggcccuccuccccuccuugcaccgagauuaauaaaaaaaagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13 - RNA, 1918 nt, Artificial Sequence
  mRNA product from modified/optimized HA-A California (A485,U266,AU751), H1N1(California2009)-HA, R5218
gggagaaagcuuaccaugaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgcgagcagcuguccagcguguccagcuucgagcgguucgagaucuuccccaagaccuccagcuggccgaaccacgacuccaacaagggggucaccgccgccugcccccacgccggcgcgaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgcuacagcaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagagcaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 14 - RNA, 1918 nt, Artificial Sequence
  mRNA product from modified/optimized HA-A Hongkong (A481,U268,AU729), H3N2(Hongkong-4801-2014)-HA, R4936
gggagaaagcuuaccaugaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacagcccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccagcggcacccucgaguucaacaacgaguccuucaacuggacgggggugacccagaacggcaccagcuccgccugcauccggcgcagcuccagcuccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaucgugagcaccaagcggucccagcaggccgugauccccaacaucggcagccgcccccggauccgcgacaucccgucccggaucagcaucuacuggaccaucgucaagccgggcgacauccuccugaucaacuccacggggaaccugaucgccccgcgcggcuacuucaagcuccggagcgggaaguccagcaucaugcgcuccgacgcccccaucggcaagugcaagagcgagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 15 - RNA, 1618 nt, Artificial Sequence
  mRNA product from modified/optimized NA-B Brisbane (371A,222U,AU593), InfluBV(Brisbane-60-2008)-NA, R5175
gggagaaagcuuaccaugcugcccagcaccauccagacccucacgcuguuccugaccuccggcggggugcuccugagccuguacgucuccgccagccucuccuaccugcuguacagcgacauccuccugaaguucuccccgaccgagaucaccgcccccacgaugccccuggacugcgcgaacgccagcaacgugcaggccgugaaccgcuccgccaccaagggcgucacccuccugcugcccgagccggaguggaccuacccccggcucagcugccccggguccacguuccagaaggcccugcugaucagcccccaccgcuucggcgagaccaaggggaacuccgcgccgcucaucauccgggagcccuucaucgccugcggccccaacgagugcaagcacuucgcccugacccacuacgccgcgcagcccggcggguacuacaacggcacccgcggggaccggaacaagcugcgccaccucaucagcgugaagcugggcaagaucccgacgguggagaacuccaucuuccacauggccgccuggagcggguccgccugccacgacggcaaggaguggaccuacaucggcgucgacgggcccgacaacaacgcccugcucaaggugaaguacggcgaggcguacaccgacaccuaccacagcuacgccaacaagauccugcggacgcaggaguccgccugcaacugcaucgggggcaacugcuaccugaugaucaccgacggcagcgccagcgggguguccgagugccgcuuccucaagauccgggagggccgcaucaucaaggagaucuuccccaccgggcgggucaagcacaccgaggagugcacgugcggcuucgccagcaacaagaccaucgagugcgcgugccgcgacaacuccuacaccgccaagcggcccuucgugaagcugaacguggagaccgacacggccgagauccgccugaugugcaccgacaccuaccucgacaccccgcggcccaacgacgggagcaucacgggccccugcgaguccaacggcgacaaggggagcggcgggaucaagggcggguucguccaccagcgcauggaguccaagaucggccggugguacagccgcaccauguccaagaccgagcggaugggcauggggcuguacgugaaguacgacggcgaccccugggccgacagcgacgcccuggcguucuccggggugauggucagcaugaaggagccgggcugguacuccuucggguucgagaucaaggacaagaagugcgacgugcccugcaucggcaucgagauggugcacgacggcgggaaggagaccuggcacagcgccgccacggccaucuacugccucaugggcuccgggcagcugcugugggacaccgucaccggcguggacauggcccucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 16 - RNA, 1627 nt, Artificial Sequence
  mRNA product from modified/optimized NA-A Hongkong (395A,230U,AU625), H3N2(Hongkong-4801-2014)-NA, R5176
gggagaaagcuuaccaugaaccccaaccagaagaucaucaccaucggcagcgugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacuggagcaagccccagugcgggaucaccggcuucgcgcccuucuccaaggacaacagcauccgccuguccgccgggggcgacaucugggucacccgggagcccuacgugagcugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccuggagcuccagcuccugccacgacggcaaggccuggcugcacgucugcaucaccggggacgacaagaacgcgaccgccagcuucaucuacaacggccggcucguggacuccguggucagcugguccaaggacauccugcgcacccaggagagcgagugcaucugcaucaacgggacgugcaccguggugaugaccgacggcuccgccagcggcaaggccgacaccaagauccuguucaucgaggaggggaagaucguccacacgagcacccucuccggcagcgcgcagcacguggaggagugcuccugcuacccccgguacccgggggugcgcugcgucugccgggacaacuggaagggcagcaaccgcccgaucguggacaucaacaucaaggaccacuccaucgugagcuccuacgucugcagcggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgagccggcucggguacgagaccuucaaggugaucgagggcugguccaacccgaagagcaagcugcagaccaaccgccaggucaucguggaccggggcgaccgcuccggguacagcgggaucuucuccguggagggcaagagcugcaucaaccggugcuucuacgucgagcugauccgcggccggaaggaggagaccgaggugcucuggacgagcaacuccaucguggucuucugcgggaccagcggcaccuacgggaccggcuccuggcccgacggggccgaccugaaccugaugcccaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 17 - RNA, 1627 nt, Artificial Sequence
  mRNA product from modified/optimized NA-A Hongkong (378A,247U,AU625), H3N2(Hongkong-4801-2014)-NA, R5951
gggagaaagcuuaccaugaaccccaaccagaagaucaucaccaucggcuccgugucccugaccaucuccacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagccggccgaguaccggaacugguccaagccccagugcgggaucaccggcuucgcgcccuucuccaaggacaacuccauccgccuguccgccgggggcgacaucugggucacccgggagcccuacguguccugcgacccggacaagugcuaccaguucgcccuggggcagggcaccacgcucaacaacgugcacuccaacaacaccguccgcgaccggacccccuaccgcacccugcugaugaacgagcucggcgugcccuuccaccuggggacgaagcaggucugcaucgccugguccuccagcuccugccacgacggcaaggccuggcugcacgucugcaucaccggggacgacaagaacgcgaccgccuccuucaucuacaacggccggcucguggacuccguggucagcugguccaaggacauccugcgcacccaggaguccgagugcaucugcaucaacgggacgugcaccguggugaugaccgacggcuccgccuccggcaaggccgacaccaagauccuguucaucgaggaggggaagaucguccacacguccacccucuccggcuccgcgcagcacguggaggagugcuccugcuacccccgguacccgggggugcgcugcgucugccgggacaacuggaagggcuccaaccgcccgaucguggacaucaacaucaaggaccacuccaucgugagcuccuacgucugcuccggccuggugggggacaccccgcggaagaacgacuccagcuccagcucccacugccuggaccccaacaacgaggagggcgggcacggcgugaaggggugggccuucgacgacggcaacgacgucuggaugggccgcaccaucaacgagacgucccggcucggguacgagaccuucaaggugaucgagggcugguccaacccgaaguccaagcugcagaccaaccgccaggucaucguggaccggggcgaccgcuccggguacuccgggaucuucuccguggagggcaaguccugcaucaaccggugcuucuacgucgagcugauccgcggccggaaggaggagaccgaggugcucuggacgagcaacuccaucguggucuucugcgggaccagcggcaccuacgggaccggcuccuggcccgacggggccgaccugaaccugaugcccaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 18 - RNA, 1627 nt, Artificial Sequence
  mRNA product from modified/optimized NA-A California (401A,238U,AU639), H1N1(California2009)-NA, R2031
gggagaaagcuuaccaugaaccccaaccagaagaucaucaccaucggcagcgugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucagcggcugggccaucuacuccaaggacaacagcgugcggaucggcuccaagggggacgucuucgugauccgcgagccguucaucagcugcuccccccuggagugccggaccuucuuccugacccagggcgcccuccugaacgacaagcacagcaacgggaccaucaaggaccgcucccccuaccggacgcugaugagcugcccgaucggcgaggugcccucccccuacaacagccgcuucgagagcgucgccugguccgcgagcgccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccaacggccaggccagcuacaagaucuuccggaucgagaaggggaagaucgugaaguccgucgagaugaacgcccccaacuaccacuacgaggagugcagcugcuaccccgacuccagcgagaucaccugcgugugccgcgacaacuggcacggcuccaaccggcccugggugagcuucaaccagaaccucgaguaccagaucggguacaucugcuccggcaucuucggggacaacccgcgccccaacgacaagacgggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 19 - RNA, 1627 nt, Artificial Sequence
  mRNA product from modified/optimized NA-A California (harmonized,375A,264U,AU639), H1N1(California2009)-NA, R5950
gggagaaagcuuaccaugaaccccaaccagaagaucaucaccaucggcuccgugugcaugaccaucgggauggccaaccugauccuccagaucggcaacaucaucuccaucuggaucucccacuccauccagcuggggaaccagaaccagaucgagacgugcaaccaguccgucaucaccuacgagaacaacaccugggugaaccagaccuacgugaacaucuccaacacgaacuucgccgcgggccaguccgucguguccgugaagcuggccgggaacagcucccucugcccggucuccggcugggccaucuacuccaaggacaacuccgugcggaucggcuccaagggggacgucuucgugauccgcgagccguucaucuccugcuccccccuggagugccggaccuucuuccugacccagggcgcccuccugaacgacaagcacuccaacgggaccaucaaggaccgcucccccuaccggacgcugauguccugcccgaucggcgaggugcccucccccuacaacucccgcuucgaguccgucgccugguccgcguccgccugccacgacgggaucaacuggcucaccaucggcaucuccggccccgacaacggggccguggccgugcugaaguacaacggcaucaucaccgacaccaucaaguccuggcggaacaacauccugcgcacgcaggaguccgagugcgcgugcgucaacggguccugcuucaccgugaugaccgacggcccguccaacggccaggccuccuacaagaucuuccggaucgagaaggggaagaucgugaaguccgucgagaugaacgcccccaacuaccacuacgaggagugcuccugcuaccccgacuccuccgagaucaccugcgugugccgcgacaacuggcacggcuccaaccggcccuggguguccuucaaccagaaccucgaguaccagaucggguacaucugcuccggcaucuucggggacaacccgcgccccaacgacaagacgggcuccugcggccccgucuccagcaacggggccaacggcgugaagggguucuccuucaaguacggcaacgggguguggaucggccggaccaaguccaucuccucccgcaacggcuucgagaugaucugggaccccaacggguggaccggcaccgacaacaacuucuccaucaagcaggacaucgucgggaucaacgagugguccggcuacuccggguccuucgugcagcacccggagcugacgggccuggacugcauccggcccugcuucuggguggagcucauccgcggccggcccaaggagaacaccaucuggaccuccggguccuccaucuccuucugcggcgucaacuccgacaccguggggugguccuggcccgacggcgccgagcugccguucacgaucgacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 20 - protein, 27 aa, Artificial Sequence
  protein sequence from HPA042205
MGIMNSFVNDIFERIAGEASRLAHYNK

SEQ ID NO: 21 - protein, 86 aa, Artificial Sequence
  protein sequence from HPA036688
MSIIQWKLVEKLSLPQNETVADTTLTKAPVSSTESVIQSNTPTPPPSQPLNETAEEESRISSSPTLLENSLEQTVEPSEDHSEEES

SEQ ID NO: 22 - protein, 143 aa, Artificial Sequence
  protein sequence from HPA000637
MSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWY

SEQ ID NO: 23 - RNA, 81 nt, Artificial Sequence
  nucleotide sequence from HPA042205
augggcaucaugaacagcuucgugaacgacaucuucgagcgcaucgccggggaggccucccggcuggcgcacuacaacaag

SEQ ID NO: 24 - RNA, 258 nt, Artificial Sequence
  nucleotide sequence from HPA036688
augagcaucauccaguggaagcugguggagaagcucucccugccccagaacgagaccgucgccgacaccacgcugaccaaggccccggugagcuccaccgagagcgugauccaguccaacacccccacgccccccccgagccagccccucaacgagaccgcggaggaggagucccgcaucagcuccagccccacccugcuggagaacucccucgagcagaccgucgagcccagcgaggaccacuccgaggaggagagc

SEQ ID NO: 25 - RNA, 429 nt, Artificial Sequence
  nucleotide sequence from HPA000637
augagcaucgaggagaagauggaggccgacgcccgcuccaucuacgugggcaacgucgacuacggggcgaccgccgaggagcuggaggcccacuuccacggcugcgggagcgugaaccgggugaccauccucugcgacaaguucuccggccaccccaagggguucgccuacaucgaguucagcgacaaggaguccguccgcacgagccuggcccuggacgagucccucuuccggggccgccagaucaaggugaucccgaagcggaccaaccgccccggcaucagcaccaccgaccggggguucccccgcgcgcgguaccgcgcccggacgaccaacuacaacuccagccgcucccgguucuacagcggcuucaacucccgcccccgggggcgcguguaccggggccgcgcccgggccaccagcugguac

SEQ ID NO: 26 - RNA, 1701 nt, Artificial Sequence
  derived and/or modified CDS sequence (AUadapt) from InfluenzaA__H3N2(Hongkong-4801-2014)-HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccucggggcgcaucaucgugagcaccaagcggucccagcaggccgugauccccaacaucggcucgcgcccccggauccgcgacaucccgucccggaucagcaucuacuggaccaucgucaagccgggcgacauccuccugaucaacuccacggggaaccugaucgccccgcgcggcuacuucaagcuccggucggggaaguccagcaucaugcgcuccgacgcccccaucggcaagugcaagucggagugcaucacccccaacggcuccaucccgaacgacaagcccuuccagaacgugaaccggaucaccuacggggccugcccccgcuacgugaagcacagcacccugaagcuggcgacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcucuucgagaagaccaagaagcagcugcgcgagaacgccgaggacauggggaacggcugcuucaagaucuaccacaagugcgacaacgcgugcaucgggucgauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 27 - RNA, 1701 nt, Artificial Sequence
  derived and/or modified CDS sequence (AUadapt) from InfluenzaA__H3N2(Hongkong-4801-2014)-HA(K176T,P210L,I219T,L276I)
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcucuucgagaagaccaagaagcagcugcgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 28 - RNA, 1701 nt, Artificial Sequence
  derived and/or modified CDS sequence (AUadapt) from InfluenzaA__H3N2(Hongkong-4801-2014)-HA(N112S,I219T,L276I)
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgucgcugcgcucccuggucgccagcuccggcacccucgaguucaacaacgagucguucaacuggacgggggugacccagaacggcaccuccagcgccugcauccggcgcuccucguccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagucgagcgggcgcaucaccguguccaccaagcggucgcagcaggccgugauccccaacaucggcucccgcccccggauccgcgacaucccgagccggaucuccaucuacuggacgaucgucaagccgggcgacauccuccugaucaacucgaccgggaaccugaucgccccgcgcggcuacuucaagauccgguccgggaagagcuccaucaugcgcucggacgcccccaucggcaagugcaaguccgagugcaucacccccaacggcagcaucccgaacgacaagcccuuccagaacgugaaccggaucaccuacggggccugcccccgcuacgugaagcacuccacgcucaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcugaagagcggcuacaaggacuggauccucuggaucagcuucgccaucuccugcuuccugcugugcguggcccuccugggcuucaucaugugggccugccagaaggggaacauccgcugcaacaucugcaucuga

SEQ ID NO: 29 - RNA, 1701 nt, Artificial Sequence
  derived and/or modified CDS sequence (AUadapt) from InfluenzaA__H1N1(California2009)-HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgcgagcagcuguccucgguguccagcuucgagcgguucgagaucuuccccaagaccuccucguggccgaaccacgacuccgacaagggggucaccgccgccugcccccacgccggcgcgaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgcuacucgaagacguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagucgaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacucgaccgucgccagcucccuggugcucguggucucgcugggggccaucuccuucuggaugugcagcaacggcucccugcagugccgcaucugcaucuga

SEQ ID NO: 30 - RNA, 1701 nt, Artificial Sequence
  derived and/or modified CDS sequence (AUadapt) from InfluenzaA__H1N1(A-California-07-2009-RefStrain)-HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgcgagcagcuguccucgguguccagcuucgagcgguucgagaucuuccccaagaccuccucguggccgaaccacgacuccaacaagggggucaccgccgccugcccccacgccggcgcgaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgcuacucgaagaaguucaagccggagaucgccauccggcccaagguccgcgaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagucgaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacucgaccgucgccagcucccuggugcucguggucucgcugggggccaucuccuucuggaugugcagcaacggcucccugcagugccgcaucugcaucuga

SEQ ID NO: 31 - RNA, 1701 nt, Artificial Sequence
  derived and/or modified CDS sequence (AUadapt) from InfluenzaA__H1N1(A-California-07-2009-RefStrain)-HA(Q240R)
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgcgagcagcuguccucgguguccagcuucgagcgguucgagaucuuccccaagaccuccucguggccgaaccacgacuccaacaagggggucaccgccgccugcccccacgccggcgcgaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgcuacucgaagaaguucaagccggagaucgccauccggcccaagguccgcgaccgggagggccgcaugaacuacuacuggacccugguggagcccggggacaagaucaccuucgaggcgaccggcaaccucguggucccccgguacgccuucgccauggagcgcaacgccggguccggcaucaucaucagcgacacgccggugcacgacugcaacaccaccugccagacccccaagggcgccaucaacacgucccugcccuuccagaacauccaccccaucaccaucgggaagugcccgaaguacgugaagucgaccaagcugcggcucgcgaccggccugcgcaacauccccuccauccagagccgggggcuguucggcgccaucgccggguucaucgagggcggcuggacggggauggucgacggcugguacggguaccaccaccagaacgagcagggcucgggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggucgcagcugaagaacaacgccaaggagaucgggaacggcugcuucgaguucuaccacaagugcgacaacaccugcauggaguccgugaagaacgggaccuacgacuaccccaaguacagcgaggaggccaagcugaaccgcgaggagaucgacggcgugaagcucgaguccacgcggaucuaccagauccuggcgaucuacucgaccgucgccagcucccuggugcucguggucucgcugggggccaucuccuucuggaugugcagcaacggcucccugcagugccgcaucugcaucuga

SEQ ID NO: 32 - RNA, 1701 nt, Artificial Sequence
  derived and/or modified CDS sequence (AUadapt) from InfluenzaA__H1N1(Netherlands2009)-HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcggggcgucgccccgcugcaccucgggaagugcaacaucgccggcuggauccuggggaacccggagugcgagagccuguccaccgcgucguccuggagcuacaucguggagaccuccucguccgacaacggcacgugcuaccccggcgacuucaucgacuacgaggagcuccgcgagcagcugagcuccgugucguccuucgagcgguucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacaccugcauggaguccgugaagaacgggaccuacgacuaccccaaguacucggaggaggccaagcugaaccgcgaggagaucgacggcgugaagcucgaguccacgcggaucuaccagauccuggcgaucuacagcaccgucgccucgucccuggugcucguggucagccugggggccaucuccuucuggaugugcagcaacggcucccugcagugccgcaucugcaucuga

SEQ ID NO: 33 - RNA, 1698 nt, Artificial Sequence
  derived and/or modified CDS sequence (AUadapt) from InfluenzaA__H1N1(Brisbane2007)-HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgccccccuccagcuggggaacugcuccgucgccggcuggauccuggggaacccggagugcgagcuccugaucagcaaggaguccuggucguacaucguggagaagcccaaccccgagaacggcaccugcuaccccggccacuucgccgacuacgaggagcugcgggagcagcucuccagcguguccagcuucgagcgcuucgagaucuucccgaaggaguccagcuggcccaaccacacggucaccgggguguccgccucgugcucccacaacggcgagagcuccuucuaccggaaccugcuguggcucaccgggaagaacggccuguaccccaaccugagcaaguccuacgcgaacaacaaggagaaggaggugcucguccuguggggcgugcaccacccgccgaacaucgggaaccagaaggcccuguaccacaccgagaacgccuacgugucggucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgccccgauggacaagugcgacgcgaagugccagaccccccagggggccaucaacucgucccugcccuuccagaacguccacccggugacgaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaagucgacccagaacgccaucaacggcaucacgaacaaggugaacuccgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccugcagugccgcaucugcaucuga

SEQ ID NO: 34 - RNA, 1701 nt, Artificial Sequence
  derived and/or modified CDS sequence (AUadapt) from InfluenzaA__H3N2(HK1-1968)-HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccggauccuggacgggaucgacugcacccugaucgacgcccuccugggcgacccccacugcgacgucuuccagaacgagacgugggaccuguucguggagcgcuccaaggccuucucgaacugcuaccccuacgacgugccggacuacgcgucccuccggagccuggucgccuccucgggcacccuggaguucaucaccgagggguucaccuggacgggcgugacccagaacgggggcuccaacgccugcaagcgcgggcccggcagcggcuucuucucccggcucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgcgucaccguguccacgcggcgcagccagcagaccaucauccccaacaucgagucgcggcccugggugcgcggccaguccagccggaucuccaucuacuggaccaucgucaagcccggcgacgugcuggugaucaacucgaacgggaaccucaucgcgccgcgcggcuacuucaagaugcggaccgggaaguccagcaucaugcgcuccgacgcccccaucgacacgugcaucucggagugcaucacccccaacggcuccauccccaacgacaagccguuccagaacgucaacaagaucaccuacggggccugccccaaguacgugaagcagaacacccugaagcuggccacgggcaugcggaacgugcccgagaagcagacccgcggccucuucggggccaucgcgggcuucaucgagaacgggugggagggcaugaucgacgggugguacggcuuccggcaccagaacagcgagggcaccgggcaggccgccgaccugaaguccacccaggccgccaucgaccagaucaacggcaaggucaaccgcaucaucgagaagacgaacgagaaguuccaccagaucgagaaggaguucucggagguggaggggcggauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcgccggcagcuccgcgagaacgccgaggacaugggcaacgggugcuucaagaucuaccacaagugcgacaacgccugcaucgaguccauccggucgggcaccuacgaccacgacguguaccgggacgaggcccugaacaaccgcuuccagaucaagggcgucgagcugaaguccggguacaaggacuggauccucuggaucagcuucgcgaucuccugcuuccugcugugcguggugcuccugggcuucaucaugugggccugccagcgggggaacauccgcugcaacaucugcaucuga

SEQ ID NO: 35 - RNA, 1695 nt, Artificial Sequence
  derived and/or modified CDS sequence (AUadapt) from InfluenzaA__H5N1(NIBRG-14)-HA
auggagaagaucgugcugcucuucgccaucgucucgcuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccucgcugggcguguccagcgccugccccuaccagggcaaguccagcuucuuccggaacguggucuggcugaucaagaagaacuccaccuaccccacgaucaagcgcucguacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagucgaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacucgccgcagcgggagacccgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagucggugcggaacggcacguacgacuacccccaguacuccgaggaggcccgccucaagcgggaggagaucagcggggucaagcuggaguccaucggcaucuaccagauccugagcaucuacuccaccguggccucgucccucgcccuggcgaucaugguggccgggcugagccucuggaugugcagcaacggcucccugcagugccgcaucugcaucuga

SEQ ID NO: 36 - RNA, 1707 nt, Artificial Sequence
  derived and/or modified CDS sequence (AUadapt) from InfluenzaA__H5N1(Vietnam2004)-HA
auggagaagaucgugcugcucuucgccaucgucucgcuggugaaguccgaccagaucugcaucggcuaccacgccaacaacagcaccgagcagguggacaccaucauggagaagaacgucacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccugcucucccgcaucaaccacuucgagaagauccagaucaucccgaagagcuccuggagcucccacgaggccucgcugggcguguccagcgccugccccuaccagggcaaguccagcuucuuccggaacguggucuggcugaucaagaagaacuccaccuaccccacgaucaagcgcucguacaacaacaccaaccaggaggaccuccuggugcugugggggauccaccaccccaacgacgcggccgagcagaccaagcucuaccagaacccgaccacguacaucuccgugggcaccagcacccugaaccagcggcuggucccccgcaucgccacccgguccaaggugaacgggcagagcggccgcauggaguucuucuggacgauccucaagcccaacgacgccaucaacuucgagucgaacgggaacuucaucgcgcccgaguacgccuacaagaucgugaagaagggcgacuccaccaucaugaagagcgagcuggaguacggcaacugcaacaccaagugccagaccccgaugggggccaucaacuccagcaugcccuuccacaacauccacccccugacgaucggcgagugccccaaguacgucaaguccaaccggcucgugcuggccaccgggcugcgcaacucgccgcagcgggagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagucggugcggaacggcacguacgacuacccccaguacuccgaggaggcccgccucaagcgggaggagaucagcggggucaagcuggaguccaucggcaucuaccagauccugagcaucuacuccaccguggccucgucccucgcccuggcgaucaugguggccgggcugagccucuggaugugcagcaacggcucccugcagugccgcaucugcaucuga

SEQ ID NO: 37 - RNA, 1683 nt, Artificial Sequence
  derived and/or modified CDS sequence (AUadapt) from InfluenzaA__H7N9(Anhui2013)-HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagugccgaccugaucaucgagcgccgggaaggguccgacgugugcuaccccggcaaguucgugaacgaggaggcccugcgccagauccuccgggagagcgggggcaucgacaaggaggcgaugggguuuaccuacuccggcauccgcaccaacggcgccaccagcgccugccggcgcuccgggagcuccuucuacgccgagaugaaguggcugcugagcaacacggauaacgcggccuucccgcagaugaccaaguccuacaagaacacccggaagagccccgcccucaucgucuggggcauccaccacuccgugagcaccgccgagcaaacgaagcuguauggguccggcaacaagcuggugaccgucggcagcuccaacuaccagcagagcuucgugcccucccccggggcccgcccgcaggugaacggccucagcgggcggaucgacuuucacuggcugaugcugaaccccaacgacaccgucaccuucagcuucaacggcgcguuuaucgcccccgaccgcgccuccuuccuccgggggaagagcaugggcauccaguccggcgugcagguggacgccaacugcgagggggacugcuaccauagcggcgggacgaucaucuccaaccugcccuuccagaacaucgacagccgcgccgucggcaagugcccgcgguacgugaagcagcgcucccugcuccuggcgaccgggaugaagaaugugcccgaaauccccaagggccggggccuguucggggccaucgccggcuucaucgagaacgggugggagggccucaucgacgggugguacggcuuccgccaccagaacgcccagggcgaggggaccgccgcggacuauaagagcacccaguccgccaucgaccagaucacgggcaagcugaaccggcugaucgagaagaccaaccagcaauucgagcucaucgacaacgaguucaaugaggucgagaagcagaucgggaacgugaucaacuggacccgcgacagcaucaccgaggugugguccuacaacgccgagcugcuggucgccauggagaaccagcacacgaucgaccucgccgauagcgagauggacaagcuguacgagcgcgugaagcggcaacugcgcgagaacgcggaggaggacggcaccggcugcuucgagaucuuccauaagugcgacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugaagaacggcaacaugcgcugcaccaucugcaucuga

SEQ ID NO: 38 - RNA, 1701 nt, Artificial Sequence
  derived and/or modified CDS sequence (AUadapt) from InfluenzaA__H1N1(Iowa88)-HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgaggaccggcacaacgggaagcugugcaagcugcgcggcguggccccccuccaccuggggaagugcaacaucgccggcuggcugcucgggaacccggagugcgagcugcuguucaccgcgucguccuggagcuacaucgucgagaccuccaacucggacaacggcacgugcuaccccggcgacuucaucaacuacgaggagcuccgggagcagcuguccagcguguccucguucgagcgcuucgagaucuuccccaaggccuccagcuggcccaaccacgagaccaaccggggcgugaccgccgccugcccguacgcgggggccaacuccuucuaccgcaaccugaucuggcucgucaagaaggggaacucguaccccaagcuguccaagagcuacgugaacaacaaggagaaggaggugcugguccucuggggcauccaccacccgcccaccuccacggaccagcagucgcuguaccagaacgccgacgccuacguguucgugggguccagcaaguacaacaagaaguucaagccggagaucgccacccggcccaagguccgcggccaggcgggccggaugaacuacuacuggacccugguggagcccggggacaccaucacguucgaggccaccggcaaccucguggucccccgcuacgccuucgccaugaagcgggggucgggcuccggcaucaucaucagcgacaccccggugcacgacugcaacaccacgugccagacccccaagggggccaucaacaccucccugcccuuccagaacauccaccccgugaccaucggcgagugcccgaaguacgucaagucgacgaagcugcgcauggcgaccgggcuccggaacauccccuccauccagagccgcggccuguucggggccaucgccggcuucaucgagggcggguggaccggcaugaucgacgggugguacggcuaccaccaccagaacgagcagggguccggcuacgccgccgaccggaagucgacccagaacgcgaucgacggcaucacgaacaaggugaacuccgugaucgagaagaugaacacccaguucaccgccgucgggaaggaguucaaccaccuggagaagcgcaucgagaaccucaacaagaagguggacgacggcuuccuggacgucuggaccuacaacgccgagcugcucgugcugcuggagaacgagcggacgcucgacuaccacgacagcaacgugaagaaccuguacgagaagguccgcucccagcugaagaacaacgccaaggagaucgggaacggcugcuucgaguucuaccacaagugcgacgacaccugcauggagucggugaagaacgggaccuacgacuaccccaaguacuccgaggagagcaagcucaaccgggaggagaucgacggcgugaagcuggaguccacccgcaucuaccagauccuggccaucuacucgacggucgcguccagccucgugcugcuggugucccucggcgccaucucguucuggaugugcagcaacgggucccugcagugccggaucugcaucuga

SEQ ID NO: 39 - RNA, 1698 nt, Artificial Sequence
  derived and/or modified CDS sequence (AUadapt) from InfluenzaA__H1N1(PR8)-HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacucgcacaacgggaagcugugccggcugaagggcaucgcgccccuccagcuggggaagugcaacaucgccggcuggcugcucgggaacccggagugcgacccccugcugcccgugcgcuccuggagcuacaucgucgagacgcccaacuccgagaacggcaucugcuacccgggcgacuucaucgacuacgaggagcuccgggagcagcugucguccgugagcuccuucgagcgcuucgagaucuuccccaaggagucguccuggcccaaccacaacaccaacggggugaccgccgccugcagccacgagggcaaguccucguucuaccggaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucucgguggugacguccaacuacaaccgccgguucacccccgagaucgccgagcgccccaagguccgggaccaggccggccgcaugaacuacuacuggacccuccugaagccgggcgacaccaucaucuucgaggccaacgggaaccugaucgccccgauguacgcguucgcccucagccggggcuucgggucgggcaucaucacguccaacgccagcaugcacgagugcaacaccaagugccagaccccccugggcgccaucaacuccucgcugcccuaccagaacauccacccggugaccaucggggagugccccaaguacgugcgcuccgccaagcuccggauggucacgggccugcgcaacaaccccagcauccagucccgggggcuguucggcgcgaucgccggguucaucgagggcggcuggaccgggaugaucgacggcugguacggguaccaccaccagaacgagcagggcucgggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggugaagucccagcucaagaacaacgccaaggagaucggcaacgggugcuucgaguucuaccacaagugcgacaacgagugcauggagucgguccgcaacggcacguacgacuaccccaaguacuccgaggagagcaagcugaaccgggagaagguggacggggugaagcuggaguccaugggcaucuaccagauccucgccaucuacucgaccgucgccuccagccuggugcugcuggugucccucggcgcgaucucguucuggaugugcagcaacgggucccugcagugccgcaucugcaucuga

SEQ ID NO: 40 - RNA, 1689 nt, Artificial Sequence
  derived and/or modified CDS sequence (AUadapt) from InfluenzaA__H2N2(Japan1957)-HA
auggccaucaucuaccugauccuccuguucaccgccgugcggggcgaccagaucugcaucggguaccacgcgaacaacucgaccgagaaggucgacacgauccuggagcgcaacgugaccgugacccacgccaaggacauccucgagaagacccacaacggcaagcugugcaagcugaacgggaucccgccgcucgagcugggcgacugcuccaucgccggguggcugcucggcaaccccgagugcgaccggcugcugucgguccccgagugguccuacaucauggagaaggagaacccccgcgacggccucugcuacccggggucguucaacgacuacgaggagcugaagcaccugcucuccucggugaagcacuucgagaaggugaagauccugcccaaggaccgguggacgcagcacaccaccaccggcgggucccgcgccugcgccgucagcggcaaccccuccuucuuccggaacaugguguggcugacggagaaggggucgaacuaccccguggcgaagggcuccuacaacaacaccucgggcgagcagaugcucaucaucuggggcguccaccacccgaacgacgagaccgagcagcgcacccuguaccagaacguggggacguacguguccgucgggaccucgacccugaacaagcgguccacccccgagaucgccacgcgccccaaggugaacggccagggcgggcggauggaguucucguggacccuccuggacaugugggacaccaucaacuucgaguccaccggcaaccugaucgcccccgaguacggguucaagaucagcaagcgcggcuccucggggaucaugaagacggagggcacccucgagaacugcgagaccaagugccagaccccgcugggcgccaucaacacgacccugcccuuccacaacgugcacccccucaccaucggggagugccccaaguacgucaagucggagaagcuggugcuggcgaccggccuccggaacgugccgcagaucgagucccgcgggcuguucggcgccaucgccggguucaucgagggcggcuggcaggggauggucgacggcugguacggguaccaccacucgaacgaccagggcuccggguacgccgccgacaaggagucgacgcagaaggcguucgacggcaucaccaacaaggugaacuccgugaucgagaagaugaacacccaguucgaggccgucggcaaggaguucagcaaccuggagcggcgccucgagaaccugaacaagaagauggaggacggguuccuggacguguggaccuacaacgccgagcuccuggugcugauggagaacgagcggacgcucgacuuccacgacuccaacgucaagaaccuguacgacaaggugcgcaugcagcugcgggacaacgucaaggagcucggcaacgggugcuucgaguucuaccacaagugcgacgacgagugcaugaacucggugaagaacggcaccuacgacuaccccaaguacgaggaggaguccaagcugaaccgcaacgagaucaagggcgugaagcugucguccaugggggucuaccagauccucgccaucuacgccaccguggcgggcucgcugucccuggccaucaugauggccgggaucucguucuggaugugcuccaacggcagccugcagugccggaucugcaucuga

SEQ ID NO: 41 - RNA, 1701 nt, Artificial Sequence
  derived and/or modified CDS sequence (AUadapt) from InfluenzaA__H3N2(Minnesota99)-HA
augaagaccaucaucgcccugucguacauccucugccugguguucgcccagaagcugccgggcaacgacaacuccaccgcgacgcucugccuggggcaccacgccgucccgaacggcacccuggugaagaccaucaccaacgaccagaucgaggugacgaacgccaccgagcucguccagagcuccucgaccgggcggaucugcgacuccccccaccgcauccuggacggcaagaacugcacccugaucgacgcccuccugggggacccccacugcgacggcuuccagaacaaggagugggaccuguucaucgagcggagcaaggccuacuccaacugcuaccccuacgacgugccggacuacagcucccuccgcucgcugguggcguccagcggcacgcuggaguucaccaacgaggacuucaacuggaccggggucgcccaggacggcggguccuacagcugcaagcgggaguccgugaagucguucuucucccgccucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgggugaccgucucgaccaaguccagccagcagacggugaucccgaacaucggcucccgccccugggugcggggcaucagcucccgcaucucgaucuacuggaccaucgucaagcccggggacauccuccugaucuccagcaccggcaaccugaucgcgccccggggguacuucaagauccgcaacggcaaguccagcaucaugcgguccgacgccccgaucgacaacugcuacucggagugcaucacccccaacggcuccauccccaacgacaagcccuuccagaacgugaaccgcaucacguacggggccugcccgaaguacgugaagcagaagacccucaagcuggccaccggcaugcggaacguccccgagaagcagacccgcgggaucuucggcgccaucgcgggguucaucgagaacggcugggagggcaugguggacgggugguacggcuuccggcaccagaacagcgaggggacgggccaggccgccgaccugaaguccacccaggccgccaucgaccaggugaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgcggagcugcugguggcccucgagaaccagcacacgaucgaccugaccgacucggagaugaacaagcuguucgagaagacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcccugaacaaccgguuccagaucaagggcguggagcugaagagcggguacaaggacuggauccucuggaucagcuucgcgaucuccugcuuccugcugugcgucgugcuccugggcuucaucaugugggccugccagaagggcaacauccgcugcaacaucugcaucuga

SEQ ID NO: 42 - RNA, 1701 nt, Artificial Sequence
  derived and/or modified CDS sequence (AUadapt) from InfluenzaA__H3N2(Texas2012)-HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacuggaacggggugacgcagaacggcaccagcuccgccugcauccggcgcucgaacaacuccuucuucagccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagccguccgggcgcaucaccgugucgaccaagcggucccagcaggccgugauccccaacaucggcagccgcccccggauccgcaacaucccgucgcggaucuccaucuacuggaccaucgucaagcccggcgacauccugcucaucaacagcacggggaaccugaucgccccgcgcggcuacuucaagauccgguccgggaagucguccaucaugcgcagcgacgcccccaucggcaagugcaaguccgagugcaucacccccaacggcucgaucccgaacgacaagcccuuccagaacgugaaccggaucaccuacggggccugcccccgcuacgugaagcaguccacccugaagcucgcgacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucucggagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcugaagucgggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 43 - RNA, 1701 nt, Artificial Sequence
  derived and/or modified CDS sequence (AUadapt) from InfluenzaA__H3N2(Uruguay2007)-HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacuccccccaccagauccucgacggcgagaacugcacccugaucgacgcccugcucggggacccccagugcgacggcuuccagaacaagaagugggaccuguucguggagcggucgaaggccuacuccaacugcuaccccuacgacgugccggacuacgcgagccugcgcucccucgucgccucguccggcacgcuggaguucaacaacgagagcuucaacuggaccggggugacccagaacggcaccuccucguccugcauccgggggagcaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccggaucaccgugagcacgaagcgcucgcagcagaccgugauccccaacaucggcucccggccccgcguccggaacauccccagccgcaucuccaucuacuggaccaucgugaagccgggggacauccugcugaucaacucgaccggcaaccucaucgccccgcggggguacuucaagauccgcuccggcaagagcuccaucaugcggucggacgcccccaucggcaagugcaacuccgagugcaucacgcccaacgggagcaucccgaacgacaagcccuuccagaacgugaaccgcaucaccuacggcgccugcccccgguacgucaagcagaacacccugaagcuggccaccgggaugcgcaacgugcccgagaagcagacgcggggcaucuucggggcgaucgccggcuucaucgagaacggcugggaggggaugguggacggcugguacggguuccgccaccagaacuccgagggcaucgggcaggccgccgaccucaagucgacccaggccgcgaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcucuucgagaagaccaagaagcagcugcgggagaacgccgaggacaugggcaacgggugcuucaagaucuaccacaagugcgacaacgccugcaucggcucgauccgcaacgggaccuacgaccacgacgucuaccgggacgaggcgcugaacaaccgguuccagaucaagggcguggagcucaaguccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 44 - RNA, 1707 nt, Artificial Sequence
  derived and/or modified CDS sequence (AUadapt) from InfluenzaA__H5N1(Bavaria06)-HA
auggagaagaucaugcugcuccuggccaucgugucgcuggucaaguccgaccagaucugcaucggcuaccacgccaacaacucgaccgagcagguggacaccaucauggagaagaacgugacggucacccacgcgcaggacauccucgagaagacccacaacgggaagcugugcgaccuggacggcgugaagccccucauccugcgggacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccugcugucccgcaucaaccacuucgagaagauccagaucaucccgaagucguccuggagcgaccacgaggccuccucgggcguguccagcgccugccccuaccagggccgguccucguucuuccgcaacgucguguggcucaucaagaaggacaacgcguaccccaccaucaagcgguccuacaacaacacgaaccaggaggaccugcuggugcucugggggauccaccaccccaacgacgccgccgagcagacccgccuguaccagaacccgaccaccuacaucucggucggcacguccacccugaaccagcggcucgugcccaagaucgccacccgcagcaaggugaacgggcaguccggccggauggaguucuucuggaccauccugaagcccaacgacgcgaucaacuucgagucgaacgggaacuucaucgcccccgagaacgccuacaagaucgucaagaagggcgacagcacgaucaugaaguccgagcuggaguacggcaacugcaacaccaagugccagaccccgaucggggccaucaacucguccaugcccuuccacaacauccacccccucaccaucggcgagugccccaaguacgugaagagcaaccgccuggugcuggccacggggcuccggaacuccccgcagggcgagcgccggcgcaagaagcggggccuguucggggcgaucgccggcuucaucgagggcggguggcaggggauggucgacggcugguacggcuaccaccacucgaacgagcagggguccggcuacgccgccgacaaggagucgacccagaaggccaucgacggggugaccaacaaggugaacuccaucaucgacaagaugaacacccaguucgaggcggucggccgcgaguucaacaaccuggagcggcgcaucgagaaccucaacaagaagauggaggacggguuccuggacguguggacguacaacgccgagcugcucgugcugauggagaacgagcggacccuggacuuccacgacagcaacgucaagaaccucuacgacaaggugcgccugcagcugcgggacaacgccaaggagcucggcaacggcugcuucgaguucuaccaccgcugcgacaacgagugcauggaguccguccggaacgggaccuacgacuacccccaguacucggaggaggcccggcugaagcgcgaggagaucuccggcgugaagcuggagagcaucgggaccuaccagauccucuccaucuacucgacgguggccuccagccuggcgcuggccaucauggucgccggccucucccuguggaugugcucgaacgggagccugcagugccggaucugcaucuga

SEQ ID NO: 45 - RNA, 1704 nt, Artificial Sequence
  derived and/or modified CDS sequence (AUadapt) from InfluenzaA__H6N1(A-Taiwan-2-2013)-HA
augaucgccaucguggucaucgccauccuggcgucggccggcaaguccgacaagaucugcaucggguaccacgccaacaacagcaccacccagguggacacgcuccuggagaagaacgugaccgucacccacuccguggagcugcucgagaaccagaaggagaagcgcuucugcaagaucaugaacaaggccccgcuggaccugaaggacugcaccaucgagggcuggauccucgggaacccgaagugcgaccugcugcucggcgaccagucgugguccuacaucguggagcggcccaacgcccagaacgggaucugcuaccccggcguccugaacgagcuggaggagcucaaggcguucaucggcagcggggagcgcguggagcgguucgagauguuccccaaguccacgugggccggcguggacaccucgcgcggggucaccaacgccugcccguccuacaccaucgacagcuccuucuaccggaaccugguguggaucgugaagacggacucggccaccuaccccgucaucaagggcaccuacaacaacaccgggacgcagcccauccuguacuucuggggcgugcaccacccccucgacaccaccgugcaggacaaccuguacggcuccggggacaaguacguccgcaugggcaccgagagcaugaacuucgcgaaguccccggagaucgccgcccggcccgccgugaacgggcagcgcucgcggaucgacuacuacugguccgugcugcgccccggcgagacgcucaacgucgagagcaacggcaaccugaucgcccccugguacgcguacaaguucguguccaccaacaagaagggggccguguucaagagcgaccugccgaucgagaacugcgacgccaccugccagaccaucacgggcguccuccggaccaacaagaccuuccagaacgugucgccccuguggaucggggagugccccaaguacgugaaguccgagagccugcgccucgccaccggccugcggaacgucccccagaucgccacgcgcgggaucuucggcgcgaucgccggcuucaucgagggcggguggaccgggaugaucgacggcugguacggguaccaccacgagaacucccagggcucgggcuacgccgccgaccgggaguccacccagaaggccaucgacgggaucaccaacaaggugaacagcaucaucaacaagaugaacacgcaguucgaggcggucgaccacgaguucuccaaccuggagcgccggaucggcaaccucaacaagcgcauggaggacggguuccuggacguguggaccuacaacgccgagcugcucgugcugcuggagaacgagcggacccucgaccugcacgacgccaacgucaagaaccuguacgagaaggugaagucgcagcuccgcgacaacgccaacgaccugggcaacgggugcuucgaguucuggcacaagugcgacaacgagugcauggaguccgugaagaacggcaccuacgacuacccgaaguaccagaaggagagcaagcugaaccggcagggcaucgaguccgucaagcucgagaaccuggggguguaccagauccuggccaucuacucgacgguguccagcucccucguccuggugggccugaucauggcgaucgggcucuggaugugcagcaacggcuccaugcagugccgcaucugcaucuga

SEQ ID NO: 46 - RNA, 1704 nt, Artificial Sequence
  derived and/or modified CDS sequence (AUadapt) from InfluenzaA__H5N8(A-chicken-Poland-79A-2016)-HA
auggagaacauggugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugucgcgcaucaaccacuucgagaagauccagaucaucccgaaguccagcuggcccaaccacgagaccucccugggcgucucggccgcgugccccuaccagggcacgcccuccuucuuccggaacgugguguggcugaucaagaagaacgacgccuacccgaccaucaagaucucguacaacaacaccaaccgcgaggaccugcucauccugugggggauccaccacuccaacaacgccgaggagcagaccaaccuguacaagaaccccacgaccuacaucagcgucggcaccuccacccucaaccagcggcuggugcccaagaucgccacgcgcucgcaggugaacgggcagcggggccgcauggacuucuucuggaccauccugaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacucgucgaugcccuuccacaacauccacccccucaccaucggggagugcccgaaguacgucaaguccaacaagcuggugcuggccaccggccuccggaacagcccccugcgcgagaagcggcgcaagcggggccuguucggggcgaucgccggcuucaucgagggcggguggcaggggaugguggacggcugguacggcuaccaccacuccaacgagcaggggucgggcuacgccgccgacaaggaguccacccagaaggccaucgacggggucacgaacaaggugaacagcaucaucgacaagaugaacacccaguucgaggcggugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacuccaacgucaagaaccuguacgacaaggugcgccugcagcuccgggacaacgcccgcgagcugggcaacggcugcuucgaguucuaccacaagugcgacaacgagugcauggagucggugcggaacgggacguacgacuacccccaguacuccgaggaggcccgccugaagcgcgaggagaucggcggggucaagcucgagucgaucggcaccuaccagauccuguccaucuacagcaccguggccuccucgcuggcgcucgccaucaugguggccgggcugucccuguggaugugcagcaacggcucccuccagugccggaucugcaucuga

SEQ ID NO: 47 - RNA, 1704 nt, Artificial Sequence
  derived and/or modified CDS sequence (AUadapt) from InfluenzaA__H5N8(A-wildduck-Germany-BW-R8455-2016)-HA
auggagaacaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugucgcgcaucaaccacuucgagaagauccugaucaucccgaaguccagcuggcccaaccacgagaccucccugggcgucucggccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucucggucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacucgaccaucaugaaguccggcguggaguacgggcacugcaacaccaagugccagacgcccgugggcgccaucaacagcucgaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggucgggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagucggugcgcaacgggacguacgacuacccccaguacuccgaggaggcccggcucaagcgcgaggagaucagcggcgucaagcuggaguccaucgggaccuaccagauccugucgaucuacuccaccguggccagcucccucgcgcuggccaucaugguggccggccugucgcucuggaugugcuccaacgggagccugcagugccgcaucugcaucuga

SEQ ID NO: 48 - RNA, 1704 nt, Artificial Sequence
  derived and/or modified CDS sequence (AUadapt) from InfluenzaA__H5N8(A-mute swan-Croatia-9-2017)-HA
auggagaacaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacgacuacgaggagcucaagcaccuccugucgcgcaucaaccacuucgagaagauccugaucaucccgaaguccagcuggcccaaccacgagaccucccugggcgucucggccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucucggucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacucgaccaucaugaaguccggcguggaguacgggcacugcaacaccaagugccagacgcccgugggcgccaucaacucgagcaugcccuuccacaacauccacccccugaccaucggggagugcccgaaguacgucaaguccaacaagcuggugcucgccaccggccugcggaacucgccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacucgaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacgacuacccccaguacuccgaggaggcccggcucaagcgcgaggagaucggcggggucaagcuggagucgaucggcaccuaccagauccuguccaucuacagcaccguggccuccucgcucgcgcuggccaucaugguggccgggcugucccucuggaugugcagcaacggcucccugcagugccgcaucugcaucuga

SEQ ID NO: 49 - RNA, 1704 nt, Artificial Sequence
  derived and/or modified CDS sequence (AUadapt) from InfluenzaA__H5N8(A-tufted duck-Germany-SH-R8444-2016)-HA
auggagaacaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggucccugaacaacuacgaggagcucaagcaccuccugucgcgcaucaaccacuucgagaagauccugaucaucccgaaguccagcuggcccaaccacgagaccucccugggcgucucggccgcgugccccuaccagggcacgcccuccuucuuccggaacgugguguggcugaucaagaagaacgacgccuacccgaccaucaagaucagcuacaacaacaccaaccgcgaggaccuccugauccugugggggauccaccacuccaacaacgccgaggagcagaccaaccucuacaagaaccccacgaccuacaucucggucggcaccuccacccugaaccagcggcuggugcccaagaucgccacgcgcagccaggugaacgggcagcggggccgcauggacuucuucuggaccauccucaagcccaacgacgcgauccacuucgaguccaacgggaacuucaucgccccggaguacgccuacaagaucgucaagaagggcgacucgaccaucaugaaguccggcguggaguacgggcacugcaacaccaagugccagacgcccgugggcgccaucaacagcucgaugcccuuccacaacauccacccccugaccaucggggagugcccgaaguacgucaaguccaacaagcuggugcucgccaccggccugcggaacagcccccugcgcgagaagcggcgcaagcggggccucuucggggcgaucgccggcuucaucgagggcggguggcaggggaugguggacggcugguacggcuaccaccacuccaacgagcaggggucgggcuacgccgccgacaaggaguccacccagaaggccaucgacggggucacgaacaaggugaacagcaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacgacgagugcauggagucggugcgcaacgggacguacgacuacccccaguacuccgaggaggcccggcucaagcgcgaggagaucagcggcgucaagcuggaguccaucgggaccuaccagauccugucgaucuacuccaccguggccagcucccucgcgcuggccaucaugguggccggccugucgcucuggaugugcuccaacgggagccugcagugccgcaucugcaucuga

SEQ ID NO: 50 - RNA, 1704 nt, Artificial Sequence
  derived and/or modified CDS sequence (AUadapt) from InfluenzaA__H5N8(A-chicken-Germany-MV-R8790-2016)-HA
auggagaacaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggucguacaucguggagcgggccaaccccgccaacgaccugugcuaccccgggucccugaacaacuacgaggagcucaagcaccuccugagccgcaucaaccacuucgagaagauccugaucaucccgaaguccucguggcccaaccacgagaccucccugggcgucagcgccgcgugccccuaccagggcacgcccuccuucuuccggaacgugguguggcugaucaagaagaacgacgccuacccgaccaucaagaucucguacaacaacaccaaccgcgaggaccuccugauccugugggggauccaccacuccaacaacgccgaggagcagaccaaccucuacaagaaccccacgaccuacaucagcgucggcaccuccacccugaaccagcggcuggugcccaagaucgccacgcgcucgcaggugaacgggcagcggggccgcauggacuucuucuggaccauccucaagcccaacgacgcgauccacuucgaguccaacgggaacuucaucgccccggaguacgccuacaagaucgucaagaagggcgacagcaccaucaugaaguccggcguggaguacgggcacugcaacaccaagugccagacgcccgugggcgccaucaacucgagcaugcccuuccacaacauccacccccugaccaucggggagugcccgaaguacgucaaguccaacaagcuggugcucgccaccggccugcggaacucgccccugcgcgagaagcggcgcaagcggggccucuucggggcgaucgccggcuucaucgagggcggguggcaggggaugguggacggcugguacggcuaccaccacuccaacgagcaggggagcggcuacgccgccgacaaggaguccacccagaaggccaucgacggggucacgaacaaggugaacucgaucaucgacaagaugaacacccaguucgaggcggugggccgcgaguucaacaaccuggagcggcgcaucgagaaccugaacaagaagauggaggacggguuccucgacgucuggaccuacaacgccgagcugcuggugcucauggagaacgagcggacccuggacuuccacgacuccaacgucaagaaccuguacgacaaggugcgccuccagcugcgggacaacgccaaggagcugggcaacggcugcuucgaguucuaccacaagugcgacaacgagugcauggagagcgugcgcaacgggacguacuacuacccccaguacuccgaggaggcccggcucaagcgcgaggagaucucgggcgucaagcuggaguccaucgggaccuaccagauccugagcaucuacuccaccguggccucgucccucgcgcuggccaucaugguggccggccugagccucuggaugugcuccaacgggagccugcagugccgcaucugcaucuga

SEQ ID NO: 51 - RNA, 1701 nt, Artificial Sequence
  derived and/or modified CDS sequence (AUadapt) from InfluenzaA__ACV82259/m1__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccgacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagacguucaagccggagaucgccauccgccccaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagucgaccaagcugcgccucgcgaccggccugcggaacauccccuccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 52 - RNA, 1701 nt, Artificial Sequence; identical to SEQ ID NO: 51
  derived and/or modified CDS sequence (AUadapt) from InfluenzaA__ACV82259/m2__HA

SEQ ID NO: 53 - RNA, 1701 nt, Artificial Sequence
  derived and/or modified CDS sequence (AUadapt) from InfluenzaA__ACP41953__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagucgaccaagcugcggcucgcgaccggccugcgcaacauccccuccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 54 - RNA, 1701 nt, Artificial Sequence
  derived and/or modified CDS sequence (AUadapt) from InfluenzaA__AFM72832__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagccggagaucgccauccgccccaagguccgggaccgcgagggccggaugaacuacuacuggacgcugguggagcccggggacaagaucaccuucgaggcgaccggcaaccucguggucccccgcuacgccuucgccauggagcggaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagucgaccaagcugcgccucgcgaccggccugcggaacauccccuccauccagagccgcgggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgugaucgagaagaugaacacccaguucaccgccgucggcaaggaguucaaccaccuggagaagcggaucgagaaccugaacaagaagguggacgacggcuuccucgacaucuggacguacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 55 - RNA, 1701 nt, Artificial Sequence
  derived and/or modified CDS sequence (AUadapt) from InfluenzaA__EPI516528__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagucgaccaagcugcggcucgcgaccggccugcgcaacauccccuccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcacugccggaucugcgucuga

SEQ ID NO: 56 - RNA, 1701 nt, Artificial Sequence
  derived and/or modified CDS sequence (AUadapt) from InfluenzaA__AGM53850__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccacccgcccaccagcgccgaccagcagucgcuguaccagaacgccgacgccuacguguucgugggcuccucgcgguacuccaagaaguucaagcccgagaucgccauccgccccaagguccgggaccaggagggccgcaugaacuacuacuggacgcugguggagcccggggacaagaucaccuucgaggcgaccggcaaccucguggucccgcgguacgccuucgccauggagcgcaacgccgggagcggcaucaucaucuccgacacccccgugcacgacugcaacacgaccugccagacccccaagggcgccaucaacaccucgcugcccuuccagaacauccacccgaucacgaucgggaagugccccaaguacgugaaguccaccaagcugcggcucgcgaccggccugcgcaacauccccagcauccagucccgggggcuguucggcgccaucgccggguucaucgagggcggcuggaccgggauggucgacggcugguacggguaccaccaccagaacgagcagggcucgggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacucgaccguggccuccagccugguccucguggugucgcugggggccaucuccuucuggaugugcagcaacggcucccugcagugccggaucugcaucuga

SEQ ID NO: 57 - RNA, 1701 nt, Artificial Sequence
  derived and/or modified CDS sequence (AUadapt) from InfluenzaA__EPI731463__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaacaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagaaguucaagccggagaucgccauccgccccaagguccggggccaggaggggcgcaugaacuacuacuggacgcugguggagcccggcgacaagaucaccuucgaggcgaccgggaaccucguggucccccgguacgccuucgccauggagcgcaacgccggcuccggcaucaucaucagcgacaccccggugcacgacugcaacacgaccugccagacccccaagggggccaucaacaccucccugcccuuccagaacauccaccccaucacgaucggcaagugcccgaaguacgucaagucgaccaagcugcggcucgcgaccgggcugcgcaacauccccuccauccagagccggggccuguucggggccaucgccggcuucaucgagggcggguggaccggcaugguggacgggugguacggcuaccaccaccagaacgagcagggguccggcuacgccgccgaccucaagucgacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggcgaucuacuccaccguggccucgagccugguccucguggugucccugggcgccaucucguucuggaugugcuccaacggcagccugcagugccggaucugcaucuga

SEQ ID NO: 58 - RNA, 1701 nt, Artificial Sequence
  derived and/or modified CDS sequence (AUadapt) from InfluenzaA__EPI696972__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcagcucccgguacucgaagacguucaagccggagaucgccauccgccccaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagucgaccaagcugcgccucgcgaccggccugcggaacauccccuccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 59 - RNA, 1701 nt, Artificial Sequence
  derived and/or modified CDS sequence (AUadapt) from InfluenzaA__EPI662594__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccucguccuggagcuacaucguggagacguccaacucggacaacgggaccugcuaccccggcgacuucaucaacuacgaggagcuccgggagcagcuguccucgguguccagcuucgagcgcuucgagaucuuccccaagaccuccucguggcccaaccacgacuccaacaagggcgucaccgccgccugcccgcacgccggcgccaagucguucuacaagaaccugaucuggcucgugaagaaggggaacuccuaccccaagcugaaccagagcuacaucaacgacaagggcaaggaggugcugguccucugggggauccaccaccccuccacgaccgcggaccagcagucgcuguaccagaacgccgacgccuacguguucgugggcaccucgcgguacuccaagaaguucaagcccgagaucgccacccgcccgaagguccgggaccaggagggccgcaugaacuacuacuggacgcugguggagcccggggacaagaucaccuucgaggccaccggcaaccucguggucccccgguacgcguucaccauggagcgcaacgccgggucgggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgccaucgcgggguucaucgagggcggcuggacggggaugguggacggcugguacggguaccaccaccagaacgagcagggcucgggguacgccgccgaccucaaguccacccagaacgccaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagucgacccgcaucuaccagauccuggccaucuacuccaccgucgccagcucccuggugcucguggucucgcugggggcgaucuccuucuggaugugcucgaacggcagccugcagugccggaucugcaucuga

SEQ ID NO: 60 - RNA, 1701 nt, Artificial Sequence
  derived and/or modified CDS sequence (AUadapt) from InfluenzaA__EPI685579__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccucguccuggagcuacaucguggagacguccaacucggacaacgggaccugcuaccccggcgacuucaucaacuacgaggagcuccgggagcagcuguccucgguguccagcuucgagcgcuucgagaucuuccccaagaccuccucguggcccaaccacgacuccaacaagggcgucaccgccgccugcccgcacgccggcgccaagucguucuacaagaaccugaucuggcucgugaagaaggggaacuccuaccccaagcugaaccagagcuacaucaacgacaagggcaaggaggugcugguccucugggggauccaccaccccuccacgaccgcggaccagcagucgcuguaccagaacgccgacgccuacguguucgugggcaccucgcgguacuccaagaaguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggucgggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcgccucgccaccggccugcggaacgucccgucgauccagucccgcgggcuguucggcgccaucgcgggguucaucgagggcggcuggacggggaugguggacggcugguacggguaccaccaccagaacgagcagggcucgggguacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagucgacccggaucuaccagauccuggccaucuacuccaccgucgccagcucccuggugcucguggucucgcugggggcgaucuccuucuggaugugcucgaacggcagccugcagugccgcaucugcaucuga

SEQ ID NO: 61 - RNA, 1701 nt, Artificial Sequence
  derived and/or modified CDS sequence (AUadapt) from InfluenzaA__EPI830230__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccaacucggacaacgggaccugcuaccccggcgacuucaucaacuacgaggagcuccgggagcagcuguccagcguguccucguucgagcgcuucgagaucuuccccaagaccuccucguggcccaaccacgacuccaacaagggcgucaccgccgccugcccgcacgccggcgccaagagcuucuacaagaaccugaucuggcucgugaagaaggggaacuccuaccccaagcugaaccagucguacaucaacgacaagggcaaggaggugcugguccucugggggauccaccaccccuccacgaccgcggaccagcagucgcuguaccagaacgccgacgccuacguguucgugggcaccagccgguacuccaagauguucaagcccgagaucgccacccgcccgaagguccgggaccgcgagggccggaugaacuacuacuggacgcugguggagcccggggacaagaucaccuucgaggccaccggcaaccucguggucccccgcuacgcguucaccauggagcggaacgccgggucgggcaucaucaucuccgacacgcccgugcacgacugcaacacgaccugccagaccccggagggcgccaucaacaccucgcugcccuuccagaacauccaccccaucaccaucgggaagugccccaaguacgugaaguccaccaagcugcgccucgccaccggccugcggaacgucccgagcauccagucccgcgggcuguucggcgccaucgcgggguucaucgagggcggcuggacggggaugguggacggcugguacggguaccaccaccagaacgagcagggcucgggguacgccgccgaccucaaguccacccagaacgccaucgacaagaucaccaacaaggugaacucggucaucgagaagaugaacacccaguucacggccgugggcaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgagaagaucgacggcgugaagcucgagucgacccggaucuaccagauccuggccaucuacuccaccgucgccucgucccuggugcucguggucagccugggggcgaucuccuucuggaugugcucgaacggcagccugcagugccgcaucugcaucuga

SEQ ID NO: 62 - RNA, 1701 nt, Artificial Sequence
  derived and/or modified CDS sequence (AUadapt) from InfluenzaA__ACQ45338__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 63 - RNA, 1701 nt, Artificial Sequence; identical to SEQ ID NO: 62
  derived and/or modified CDS sequence (AUadapt) from InfluenzaA__ACQ45338/m1__HA

SEQ ID NO: 64 - RNA, 1701 nt, Artificial Sequence; identical to SEQ ID NO: 62
  derived and/or modified CDS sequence (AUadapt) from InfluenzaA__ACQ45338/m2__HA

SEQ ID NO: 65 - RNA, 1701 nt, Artificial Sequence
  derived and/or modified CDS sequence (AUadapt) from InfluenzaA__ACU79871__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 66 - RNA, 1701 nt, Artificial Sequence
  derived and/or modified CDS sequence (AUadapt) from InfluenzaA__ACU79871/m1__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucgagucgcgccccugggugcggggccaguccagccgcaucuccaucuacuggaccaucgucaagcccggcgacgugcuggugaucaacucgaacgggaaccucaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcuggccacgggcaugcgcaacgugcccgagaagcagacccggggccucuucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaaggucaaccggaucaucgagaagacgaacgagaaguuccaccagaucgagaaggaguucucggagguggaggggcgcauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcggcgccagcuccgggagaacgccgaggacaugggcaacgggugcuucaagaucuaccacaagugcgacaacgccugcaucgaguccauccgcucgggcaccuacgaccacgacguguaccgcgacgaggcccugaacaaccgguuccagaucaagggcgucgagcugaaguccggguacaaggacuggauccucuggaucagcuucgcgaucuccugcuuccugcugugcguggugcuccugggcuucaucaugugggccugccagcgcgggaacauccggugcaacaucugcaucuga

SEQ ID NO: 67 - RNA, 1701 nt, Artificial Sequence
  derived and/or modified CDS sequence (AUadapt) from InfluenzaA__EPI643118__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccucggggcgcaucaucgugagcaccaagcggucccagcaggccgugauccccaacaucggcucgcgcccccggauccgcgacauccccucccggaucagcaucuacuggaccaucgucaagccgggcgacauccuccugaucaacuccacggggaaccugaucgcgccccgcggcuacuucaagcuccggucggggaaguccagcaucaugcgcuccgacgcccccaucggcaagugcaagucggagugcaucacccccaacggcuccaucccgaacgacaagcccuuccagaacgugaaccggaucaccuacggggccugcccccgcuacgugaagcacagcacccugaagcuggccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgagguggagggccgcauccaggaccucgagaaguacgucgaggacacgaagaucgaccuguggagcuacaacgccgagcugcucguggcccuggagaaccagcacaccaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccggaacggcacguacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 68 - RNA, 1701 nt, Artificial Sequence
  derived and/or modified CDS sequence (AUadapt) from InfluenzaA__EPI675798__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 69 - RNA, 1701 nt, Artificial Sequence
  derived and/or modified CDS sequence (AUadapt) from InfluenzaA__EPI578430__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgucgcugcgcucccuggucgccagcuccggcacccucgaguucaacaacgagucguucaacuggacgggggugacccagaacggcaccuccagcgccugcauccggcgcuccucguccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagucgagcgggcgcaucaccguguccaccaagcggucgcagcaggccgugauccccaacaucggcucccgcccccggauccgcgacauccccagccggaucuccaucuacuggacgaucgucaagccgggcgacauccuccugaucaacucgaccgggaaccugaucgcgccccgcggcuacuucaagauccgguccggcaagagcuccaucaugcgcucggacgcccccaucgggaagugcaaguccgagugcaucacccccaacggcagcaucccgaacgacaagcccuuccagaacgugaaccggaucaccuacggggccugcccccgcuacgugaagcacuccacgcucaagcuggccaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcugugcguggcccuccugggcuucaucaugugggccugccagaaggggaacauccgcugcaacaucugcaucuga

SEQ ID NO: 70 - RNA, 1701 nt, Artificial Sequence
  derived and/or modified CDS sequence (AUadapt) from InfluenzaA__EPI614406__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgucgcugcgcucccuggucgccagcuccggcacccucgaguucaacaacgagucguucaacuggacgggggugacccagaacggcaccuccagcgccugcauccggcgcuccucguccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagucgagcgggcgcaucaccguguccaccaagcggucgcagcaggccgugauccccaacaucggcucccgcccccggauccgcaacauccccagccggaucuccaucuacuggacgaucgucaagccgggcgacauccuccugaucaacucgaccgggaaccugaucgcgccccgcggcuacuucaagauccgguccggcaagagcuccaucaugcgcucggacgcccccaucgggaagugcaaguccgagugcaucacccccaacggcagcaucccgaacgacaagcccuuccagaacgugaaccggaucaccuacggggccugcccccgcuacgugaagcacuccacgcucaagcuggccaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcugugcguggcccuccugggcuucaucaugugggccugccagaaggggaacauccgcugcaacaucugcaucuga

SEQ ID NO: 71 - RNA, 1695 nt, Artificial Sequence
  derived and/or modified CDS sequence (AUadapt) from InfluenzaA__ACU65077/m1__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccacgaucaagcggucguacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagucgaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacucgccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucacgaacaaggugaacagcaucaucgacaagaugaacacccaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcacguacgacuacccccaguacuccgaggaggcccggcucaagcgcgaggagaucagcggggucaagcuggaguccaucggcaucuaccagauccugagcaucuacuccaccguggccucgucccucgcccuggcgaucaugguggccgggcugagccucuggaugugcagcaacggcucccugcagugccggaucugcaucuga

SEQ ID NO: 72 - RNA, 1695 nt, Artificial Sequence; identical to SEQ ID NO: 71
  derived and/or modified CDS sequence (AUadapt) from InfluenzaA__ACU65077/m2__HA

SEQ ID NO: 73 - RNA, 1707 nt, Artificial Sequence
  derived and/or modified CDS sequence (AUadapt) from InfluenzaA__ABP51976__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccacgaucaagcggucguacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagucgaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacucgccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagucggugcggaacggcaccuacgacuacccccaguacuccgaggaggcccgccucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 74 - RNA, 1707 nt, Artificial Sequence; identical to SEQ ID NO: 73
  derived and/or modified CDS sequence (AUadapt) from InfluenzaA__ABP51976/m1__HA

SEQ ID NO: 75 - RNA, 1695 nt, Artificial Sequence
  derived and/or modified CDS sequence (AUadapt) from InfluenzaA__ABW90125__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuacugguccagccacgaggccucccugggcgugucguccgccugcccguaccagggcaagagcuccuucuuccgcaacguggucuggcugaccaagaagaacucgaccuaccccacgaucaagcgguccuacaacaacaccaaccaggaggaccuccuggugcugugggggauccaccaccccaacgacgcggccgagcagaccaagcucuaccagaacccgaccacguacaucagcgugggcaccuccacccugaaccagcgccuggucccccggaucgccacccgcagcaaggugaacgggcaguccggccggauggaguucuucuggacgauccucaagcccaacgacgccaucaacuucgagucgaacgggaacuucaucgcgcccgaguacgccuacaagaucgugaagaagggcgacagcaccaucaugaaguccgagcuggaguacggcaacugcaacaccaagugccagaccccgaugggggccaucaacucguccaugcccuuccacaacauccacccccugacgaucggcgagugccccaaguacgucaagagcaaccgccucgugcuggccaccgggcugcggaacuccccgcagcgcgagacccggggccucuucggcgccaucgcgggguucaucgagggcggguggcagggcaugguggacgggugguacggcuaccaccacagcaacgagcagggcuccggguacgccgccgacaaggagucgacccagaaggccaucgacggcgucacgaacaaggugaacuccaucaucgacaagaugaacacccaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacagcaacgucaagaaccuguacgacaaggugcgccuccagcugcgggacaacgccaaggagcuggggaacggcugcuucgaguucuaccacaagugcgacaacgagugcauggaguccgugcgcaacggcacguacgacuacccccaguacucggaggaggcccggcucaagcgcgaggagaucuccggggucaagcuggagagcaucggcaucuaccagauccuguccaucuacagcaccguggccuccucgcucgcccuggcgaucaugguggccgggcugucccucuggaugugcagcaacggcagccugcagugccggaucugcaucuga

SEQ ID NO: 76 - RNA, 1695 nt, Artificial Sequence
  derived and/or modified CDS sequence (AUadapt) from InfluenzaA__ABW90126__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccaccaucaaggggucguacaacaacacgaaccaggaggaccuccuggugcuguggggcauccaccaccccaacgacgcggccgagcagaccaagcucuaccagaacccgaccaccuacaucuccguggggacgagcacccugaaccagcggcuggucccccgcaucgccacccgguccaaggugaacggccagagcgggcgcauggaguucuucuggaccauccucaagcccaacgacgccaucaacuucgagucgaacggcaacuucaucgcgcccgaguacgccuacaagaucgugaagaagggcgacuccacgaucaugaaguccgagcuggaguacgggaacugcaacaccaagugccagaccccgaugggcgccaucaacagcagcaugcccuuccacaacauccacccccugaccaucggggagugccccaaguacgucaaguccaaccggcucgugcuggccacgggccugcgcaacucgccgcagcgggagacccgcggccucuucggggccaucgcgggcuucaucgagggcggguggcaggggaugguggacggcugguacggcuaccaccacuccaacgagcaggggagcggcuacgccgccgacaaggaguccacccagaaggccaucgacggggucaccaacaaggugaacagcaucaucgacaagaugaacacgcaguucgaggccgugggccgggaguucaacaaccuggagcgccggaucgagaaccugaacaagaagauggaggacggguuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcugggcaacggcugcuucgaguucuaccacaagugcgacaacgagugcauggagucggugcggaacgggaccuacgacuacccccaguacuccgaggaggcccgccucaagcgggaggagaucagcggcgucaagcuggaguccaucgggaucuaccagauccugagcaucuacuccacgguggccucgucccucgcccuggcgaucaugguggccggccugagccucuggaugugcagcaacgggucccugcagugccgcaucugcaucuga

SEQ ID NO: 77 - RNA, 1695 nt, Artificial Sequence
  derived and/or modified CDS sequence (AUadapt) from InfluenzaA__ABW90127__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcgaguccagcuucuuccgcaacguggucuggcugaucaagaagaacuccaccuaccccaccaucaagcggucguacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagucgaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacucgccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcaccuacgacuacccccaguacuccgaggaggcccggcucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 78 - RNA, 1695 nt, Artificial Sequence
  derived and/or modified CDS sequence (AUadapt) from InfluenzaA__ABW90128__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucgagaagaacuccaccuaccccaccaucaagcggucguacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagucgaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacucgccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcaccuacgacuacccccaguacuccgaggaggcccggcucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 79 - RNA, 1695 nt, Artificial Sequence
  derived and/or modified CDS sequence (AUadapt) from InfluenzaA__ABW90129__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccgcguaccccaccaucaagcggucguacaacaacaccaaccaggaggaccuccuggugcugugggggauccaccaccccaacgacgccgccgagcagacggagcucuaccagaacccgaccaccuacaucuccgugggcaccagcacgcugaaccagcgccuggucccccggaucgccacccgcuccaaggugaacgggcagagcggccggauggaguucuucuggaccauccucaagcccaacgacgcgaucaacuucgagucgaacgggaacuucaucgcccccgaguacgccuacaagaucgugaagaagggcgacuccaccaucaugaaguccgagcuggaguacggcaacugcaacacgaagugccagaccccgaugggggccaucaacagcagcaugcccuuccacaacauccacccccugaccaucggcgagugccccaaguacgucaaguccaaccgccucgugcuggccaccgggcugcggaacucgccgcagcgcgagacgcggggccucuucggcgcgaucgccggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacccaguucgaggcgguggggcgcgaguucaacaaccuggagcggcgcaucgagaaccugaacaagaagauggaggacggcuuccucgacgucuggacguacaacgccgagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcaccuacgacuacccccaguacuccgaggaggcccggcucaagcgcgaggagaucagcggggucaagcuggaguccaucggcaucuaccagauccugagcaucuacuccaccguggccucgucccucgcgcuggccaucaugguggccgggcugagccucuggaugugcagcaacggcucccugcagugccggaucugcaucuga

SEQ ID NO: 80 - RNA, 1695 nt, Artificial Sequence
  derived and/or modified CDS sequence (AUadapt) from InfluenzaA__ABW90130__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagucguccuggagcucccacgaggccagccugggcguguccucggccugcccguaccagggcaaguucuccuucuuccgcaacguggucuggcugaucaagaagaacagcaccuaccccaccaucaagcgguccuacaacaacacgaaccaggaggaccuccuggugcugugggggauccaccaccccaacgacgcggccgagcagaccaagcucuaccagaacccgaccaccuacaucagcgugggcacguccacccugaaccagcgccuggucccccggaucgccacccgcucgaaggugaacgggcaguccggccggauggaguucuucuggaccauccucaagcccaacgacgccaucaacuucgagagcaacgggaacuucaucgcgcccgaguacgccuacaagaucgugaagaagggcgacagcacgaucaugaaguccgagcuggaguacggcaacugcaacaccaagugccagaccccgaugggggccaucaacagcuccaugcccuuccacaacauccacccccugaccaucggcgagugccccaaguacgucaagucgaaccgccucgugcuggccacggggcugcggaacuccccgcagcgcgagacccggggccucuucggcgccaucgcgggguucaucgagggcggguggcagggcaugguggacgggugguacggcuaccaccacagcaacgagcagggcuccggguacgccgccgacaaggagagcacccagaaggccaucgacggcgucaccaacaaggugaacuccaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacucgaacgucaagaaccuguacgacaaggugcgccuccagcugcgggacaacgccaaggagcuggggaacggcugcuucgaguucuaccacaagugcgacaacgagugcauggaguccgugcgcaacggcaccuacgacuacccccaguacagcgaggaggcccggcucaagcgcgaggagaucuccggggucaagcuggagagcaucggcaucuaccagauccuguccaucuacucgacgguggccuccagccucgcccuggcgaucaugguggccgggcugucccucuggaugugcagcaacggcagccugcagugccggaucugcaucuga

SEQ ID NO: 81 - RNA, 1695 nt, Artificial Sequence
  derived and/or modified CDS sequence (AUadapt) from InfluenzaA__ABW90132__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccaccaucaagcggucguacaacaacacgaaccaggaggaccuccuggugcugugggggauccaccaccccaacaacgcggccgagcagaccgagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagucgaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacucgccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcaccuacgacuacccccaguacuccgaggaggcccggcucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 82 - RNA, 1695 nt, Artificial Sequence
  derived and/or modified CDS sequence (AUadapt) from InfluenzaA__ABW90133__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugccccuaccagggcaagcccuccuucuuccgcaacguggucuggcugaucaagaagaacucgaccuaccccaccaucaagcgguccuacaacaacacgaaccaggaggaccuccuggugcugugggggauccaccacccgaacgacgcggccgagcagaccaagcucuaccagaaccccaccaccuacaucagcgugggcacguccacccugaaccagcgccuggucccccggaucgccacccgcagcaaggugaacgggcaguccggccggauggaguucuucuggaccauccucaagcccaacgacgccaucaacuucgagucgaacgggaacuucaucgcgccggaguacgccuacaagaucgugaagaagggcgacagcacgaucaugaaguccgagcuggaguacggcaacugcaacaccaagugccagacccccaugggggccaucaacucguccaugcccuuccacaacauccacccccugaccaucggcgagugcccgaaguacgucaagagcaaccgccucgugcuggccacggggcugcggaacuccccgcagcgcgagacccggggccucuucggcgccaucgcgggguucaucgagggcggguggcagggcaugguggacgggugguacggcuaccaccacagcaacgagcagggcuccggguacgccgccgacaaggagucgacccagaaggccaucgacggcgucaccaacaaggugaacuccaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacagcaacgucaagaaccuguacgacaaggugcgccuccagcugcgggacaacgccaaggagcuggggaacggcugcuucgaguucuaccacaagugcgacaacgagugcauggaguccgugcgcaacggcaccuacgacuacccccaguacucggaggaggcccggcucaagcgcgaggagaucuccggggucaagcuggagagcaucggcaucuaccagauccuguccaucuacagcacgguggccuccucgcucgcccuggcgaucaugguggccgggcugucccucuggaugugcagcaacggcagccugcagugccggaucugcaucuga

SEQ ID NO: 83 - RNA, 1695 nt, Artificial Sequence
  derived and/or modified CDS sequence (AUadapt) from InfluenzaA__ABW90134__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccaggagaaguccagcuucuuccgcaacguggucuggcugaucaagaagaacuccaccuaccccaccaucaagcggucguacaacaacacgaaccaggaggaccuccuggugcuguggggcauccaccaccccaacgacgcggccgagcagaccaagcucuaccagaacccgaccaccuacaucuccguggggacgagcacccugaaccagcgccuggucccccggaucgccacccgcuccaaggugaacggccagagcgggcggauggaguucuucuggaccauccucaagcccaacgacgccaucaacuucgagucgaacggcaacuucaucgcgcccgaguacgccuacaagaucgugaagaagggggacuccacgaucaugaaguccgagcuggaguacggcaacugcaacaccaagugccagaccccgaugggcgccaucaacagcagcaugcccuuccacaacauccacccccugaccaucggggagugccccaaguacgucaaguccaaccgccucgugcuggccacgggccugcggaacucgccgcagcgcgagacccggggccucuucggggccaucgcgggcuucaucgagggcggguggcaggggaugguggacggcugguacggguaccaccacuccaacgagcagggcagcggcuacgccgccgacaaggaguccacccagaaggccaucgacggggucaccaacaaggugaacagcaucaucgacaagaugaacacgcaguucgaggccgugggccgcgaguucaacaaccuggagcggcgcaucgagaaccugaacaagaagauggaggacggguuccucgacgucuggaccuacaacgcggagcugcuggugcucauggagaacgagcggacccuggacuuccacgacuccaacgucaagaaccuguacgacaaggugcgccuccagcugcgggacaacgccaaggagcugggcaacgggugcuucgaguucuaccacaagugcgacaacgagugcauggagucggugcgcaacggcaccuacgacuacccccaguacuccgaggaggcccggcucaagcgcgaggagaucagcggcgucaagcuggaguccaucgggaucuaccagauccugagcaucuacuccacgguggccucgucccucgcccuggcgaucaugguggccggccugagccucuggaugugcagcaacgggucccugcagugccggaucugcaucuga

SEQ ID NO: 84 - RNA, 1695 nt, Artificial Sequence
  derived and/or modified CDS sequence (AUadapt) from InfluenzaA__ABW90135__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaacaagaacuccaccuaccccaccaucaagcggucguacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagucgaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacucgccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcaccuacgacuacccccaguacuccgaggaggcccggcucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 85 - RNA, 1695 nt, Artificial Sequence
  derived and/or modified CDS sequence (AUadapt) from InfluenzaA__HB649491__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagaagcacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccaccaucaagcggucguacaacaacacgaaccaggaggaccuccuggugcugugggggauccaccaccccaacgacgcggccgagcagaccaagcucuaccagaacccgaccaccuacaucuccgugggcacgagcacccugaaccagcgccuggucccccggaucgccacccgcuccaaggugaacgggcagagcggccggauggaguucuucuggaccauccucaagcccaacgacgccaucaacuucgagucgaacgggaacuucaucgcgcccgaguacgccuacaagaucgugaagaagggcgacuccacgaucaugaaguccgagcuggaguacggcaacugcaacaccaagugccagaccccgaugggggccaucaacagcagcaugcccuuccacaacauccacccccugaccaucggcgagugccccaaguacgucaaguccaaccgccucgugcuggccacggggcugcggaacucgccgcagcgcgagacccggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcaccuacgacuacccccaguacuccgaggaggcccggcucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 86 - RNA, 1683 nt, Artificial Sequence
  derived and/or modified CDS sequence (AUadapt) from InfluenzaA__EPI439507__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagugccgaccugaucaucgagcgccgggaaggguccgacgugugcuaccccggcaaguucgugaacgaggaggcccugcgccagauccuccgggagagcgggggcaucgacaaggaggcgaugggguuuaccuacuccggcauccgcaccaacggcgccaccagcgccugccggcgcuccgggagcuccuucuacgccgagaugaaguggcugcugagcaacacggauaacgcggccuucccgcagaugaccaaguccuacaagaacacccgcaagagccccgcccucaucgucuggggcauccaccacuccgugagcaccgccgagcaaacgaagcuguauggguccggcaacaagcuggugaccgucggcagcuccaacuaccagcagagcuucgugcccucccccggggcccggccccaggugaacggccucagcgggcggaucgacuuucacuggcugaugcugaaccccaacgacaccgucaccuucagcuucaacggcgcguuuaucgcccccgaccgcgccuccuuccuccggggcaagagcauggggauccaguccggcguccagguggacgccaacugcgagggggacugcuaccauagcggcgggacgaucaucuccaaccugcccuuccagaacaucgacagccgcgccgugggcaagugcccgcgguacgugaagcagcgcucccugcuccuggcgaccgggaugaagaaugugcccgaaauccccaagggccggggccuguucggggccaucgccggcuucaucgagaacgggugggagggccucaucgacgggugguacggcuuccgccaccagaacgcccagggcgaggggaccgccgcggacuauaagagcacccaguccgccaucgaccagaucacgggcaagcugaaccggcugaucgagaagaccaaccagcaauucgagcucaucgacaacgaguucaaugaggucgagaagcagaucgggaacgugaucaacuggacccgcgacagcaucaccgaggugugguccuacaacgccgagcugcuggucgccauggagaaccagcacacgaucgaccucgccgauagcgagauggacaagcuguacgagcgcgugaagcggcaacugcgcgagaacgcggaggaggacggcaccggcugcuucgagaucuuccauaagugcgacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugaagaacggcaacaugcgcugcaccaucugcaucuga

SEQ ID NO: 87 - RNA, 1701 nt, Artificial Sequence
  derived and/or modified CDS sequence (AUadapt) from InfluenzaA__EPI482777__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagucgcucuccaccgccagcuccuggucguacaucguggagacguccaacagcgacaacgggaccugcuaccccggcgacuucaucaacuacgaggagcugcgcgagcagcuguccucgguguccagcuucgagcgguucgagaucuuccccaagaccuccucguggcccaaccacgacaccaaccgcggcgucacggccgccugcccgcacgccggcgccaacuccuucuaccggaaccucguguggcuggugaagaaggggaacagcuaccccaagaucaacaaguccuacaucaacaacaaggagaaggagguccuggugcucugggcgauccaccaccccucgaccuccgccgaccagcagagccuguaccagaacgccgacgccuacguguucgucggcucgucccgcuacagccggaaguucgagcccgagaucgccacccgcccgaaggugcgggaccaggcggggcgcaugaacuacuacuggacccugguggagcccggcgacaagaucacguucgaggccaccggcaaccucgucgcgccccgguacgccuucgcccugaagcgcaacuccgggucgggcaucaucaucuccgacaccagcgugcacgacugcgacaccacgugccagacccccaacggggccaucaacaccucccugccguuccagaacauccaccccgugaccaucggcgagugccccaaguacgucaagucgacgaagcuccggauggccaccggccugcgcaacauccccuccauccagagccgggggcuguucggcgccaucgccggguucaucgagggcggguggaccggcaugaucgacggcugguacggguaccaccaccagaacgagcagggcuccggguacgccgcggaccucaagucgacccagaacgccaucgacggcaucacgaacaaggugaacuccgugaucgagaagaugaacacccaguucaccgccgucgggaaggaguucagccaccuggagcgccggaucgagaaccugaacaagaagguggacgacggcuuccucgacaucuggaccuacaacgccgagcugcugguccuccuggagaacgagcgcacgcuggacuaccacgacuccaacgugaagaaccucuacgagaaggugcggucgcagcugaagaacaacgccaaggagaucggcaacgggugcuucgaguucuaccacaagugcgacgacaugugcauggaguccgucaagaacggcaccuacgacuacccgaaguacagcgaggaggcgaagcugaaccgcgaggagaucgacggggugaagcucgaguccacccggaucuaccagauccuggccaucuacucgaccguggccagcucccugguccucguggugucgcugggcgccaucuccuucuggaugugcagcaacgggucccugcagugccgcaucugcaucuga

SEQ ID NO: 88 - RNA, 1701 nt, Artificial Sequence
  derived and/or modified CDS sequence (AUadapt) from InfluenzaA__EPI745532__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 89 - RNA, 1701 nt, Artificial Sequence
  derived and/or modified CDS sequence (AUadapt) from InfluenzaA__EPI278594__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccgaccacgagagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 90 - RNA, 1701 nt, Artificial Sequence
  derived and/or modified CDS sequence (AUadapt) from InfluenzaA__AEE69009__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccacccgcccaccagcgccgaccagcagucgcuguaccagaacgccgacacguacguguucgugggcuccucgcgguacuccaagaaguucaagcccgagaucgccauccgccccaagguccgggaccaggagggccgcaugaacuacuacuggacccugguggagcccggggacaagaucaccuucgaggccaccggcaaccucguggucccgcgguacgcguucgccauggagcgcaacgccgggagcggcaucaucaucuccgacacgcccgugcacgacugcaacacgaccugccagacccccaagggcgccaucaacaccucgcugcccuuccagaacauccacccgaucaccaucgggaagugccccaaguacgugaaguccaccaagcugcggcucgccaccggccugcgcaacauccccagcauccagucccgggggcuguucggcgcgaucgccggguucaucgagggcggcuggacggggauggucgacggcugguacggguaccaccaccagaacgagcagggcucgggguacgccgccgaccucaaguccacccagaacgccaucgacgagaucaccaacaaggugaacagcgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggccaucuacucgaccguggcguccagccugguccucguggugucgcugggggccaucuccuucuggaugugcagcaacggcucccugcagugccggaucugcaucuga

SEQ ID NO: 91 - RNA, 1701 nt, Artificial Sequence
  derived and/or modified CDS sequence (AUadapt) from InfluenzaA__GQ280797__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcaguccaucuaccagaacgccgacacguacguguucgugggcagcucccgguacucgaagaaguucaagccggagaucgccauccgccccaagguccgggaccaggagggccgcaugaacuacuacuggacccugguggagcccggggacaagaucaccuucgaggccaccggcaaccugguggucccccgguacgcguucgccauggagcgcaacgccggguccggcaucaucaucagcgacacgccggugcacgacugcaacacgaccugccagacccccaagggcgccaucaacaccucccuccccuuccagaacauccaccccaucaccaucgggaagugcccgaaguacgucaagucgaccaagcugcggcuggccaccggccuccgcaacauccccuccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacgagaucaccaacaaggugaacuccgugaucgagaagaugaacacccaguucacggcggucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcuggagagcacccgcaucuaccagauccucgccaucuacuccaccguggcgucgagccugguccugguggugucccucggggccaucucguucuggaugugcuccaacggcagccugcagugccggaucugcaucuga

SEQ ID NO: 92 - RNA, 1701 nt, Artificial Sequence
  derived and/or modified CDS sequence (AUadapt) from InfluenzaA__EPI178457__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacacguacguguucgugggcagcucccgguacucgaagaaguucaagccggagaucgccauccgccccaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagucgaccaagcugcggcucgccaccggccugcgcaacauccccuccauccagagccgggggcuguucggcgcgaucgccggguucaucgagggcggcuggacggggaugguggacggcugguacggguaccaccaccagaacgagcagggcuccggguacgccgccgaccucaagucgacccagaacgccaucgacgagaucaccaacaaggugaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggcgucgagccugguccucguggugucccugggggccaucucguucuggaugugcuccaacggcagccugcagugccggaucugcaucuga

SEQ ID NO: 93 - RNA, 1701 nt, Artificial Sequence; identical to SEQ ID NO: 92
  derived and/or modified CDS sequence (AUadapt) from InfluenzaA__EPI176470__HA

SEQ ID NO: 94 - RNA, 1701 nt, Artificial Sequence
  derived and/or modified CDS sequence (AUadapt) from InfluenzaA__EPI280341__HA
augaaggccauccuggugguccuccugcacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugucguccuucgagcgcuucgagaucuuccccaagaccagcuccuggcccgaccacgacucgaacaagggggucaccgccgccugcccgcacgccggcgcgaaguccuucuacaagaaccugaucuggcucgugaagaaggggaacagcuaccccacccuguccaagucguacaucaacgacaagggcaaggaggugcugguccucugggggauccaccaccccucgacguccgccgaccagcagagccuguaccagaacgccgacgccuacguguucgugggcaccucccgguacucgaagaaguucaagcccgagaucgccauccgcccgaagguccggaaccaggagggccgcaugaacuacuacuggacccugguggagcccggggacaagaucaccuucgaggcgacgggcaaccucguggcgccccgguacgccuucgccauggagcgcaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagagcacccagaacgccaucgacaagaucaccaacaaggugaacuccgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacucgaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggcgaagcugaaccgggaggagaucgacggcgugaagcucgagucgacccgcaucuaccagauccuggccaucuacuccaccguggccucgagccugguccucguggugucccugggggccaucucguucuggaugugcuccaacggcagccugcagugccggaucugcaucuga

SEQ ID NO: 95 - RNA, 1701 nt, Artificial Sequence
  derived and/or modified CDS sequence (AUadapt) from InfluenzaA__EPI240319__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccugguggucccccgcuacgccuucgccauggagcggaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcgccuggcgaccggccuccggaacgucccgucgauccagucccgcgggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcggaucgagaaccugaacaagaaggucgacgacggcuuccuggacaucuggacguacaacgccgagcuccuggugcugcucgagaacgagcgcacccuggacuaccacgacuccaacgugaagaaccuguacgagaagguccggagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcuggaguccacccggaucuaccagauccucgcgaucuacagcaccgucgccucgucccuggugcugguggucagccucggggccaucuccuucuggaugugcagcaacggcucccugcagugccgcaucugcaucuga

SEQ ID NO: 96 - RNA, 1701 nt, Artificial Sequence
  derived and/or modified CDS sequence (AUadapt) from InfluenzaA__EPI183134__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 97 - RNA, 1701 nt, Artificial Sequence
  derived and/or modified CDS sequence (AUadapt) from InfluenzaA__EPI368693__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccuccugcccgcacgccggcgccaagagcuucuacaagaaccugaucuggcuggugaagaaggggaacuccuaccccaagcucucgaagagcuacaucaacgacaagggcaaggaggugcugguccugugggggauccaccaccccuccaccagcgcggaccagcagucccucuaccagaacgccgacgccuacguguucgugggcucgucccgguacagcaagaaguucaagcccgagaucgccauccgcccgaagguccggggccaggaggggcgcaugaacuacuacuggacgcugguggagcccggcgacaagaucaccuucgaggccaccgggaaccugguggucccccgguacgcguucgccauggagcgcaacgccggcuccggcaucaucaucucggacacccccgugcacgacugcaacacgaccugccagaccccgaagggggccaucaacaccucccuccccuuccagaacauccaccccaucacgaucggcaagugccccaaguacgucaagagcaccaagcugcggcuggccaccgggcuccgcaacgugccguccauccagucgcggggccuguucggggcgaucgccggcuucaucgagggcggguggaccggcaugguggacgggugguacggcuaccaccaccagaacgagcagggguccggcuacgccgccgaccucaagagcacgcagaacgccaucgacgagaucaccaacaaggugaacuccgucaucgagaagaugaacacccaguucaccgcggugggcaaggaguucaaccaccuggagaagcgcaucgagaaccugaacaagaaggucgacgacggguuccuggacaucuggacguacaacgccgagcuccuggugcugcucgagaacgagcggacccuggacuaccacgacucgaacgugaagaaccuguacgagaagguccgcucccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagucgacccgcaucuaccagauccucgccaucuacagcaccgucgcguccucgcuggugcugguggucucccucggcgccaucagcuucuggaugugcuccaacggcagccugcagugccggaucugcaucuga

SEQ ID NO: 98 - RNA, 1701 nt, Artificial Sequence
  derived and/or modified CDS sequence (AUadapt) from InfluenzaA__EPI291788__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagucgcucuccaccgccagcuccuggucguacaucguggagacguccaacagcgacaacgggaccugcuaccccggcgacuucaucaacuacgaggagcugcgcgagcagcuguccucgguguccagcuucgagcgguucgagaucuuccccaagaccuccucguggcccaaccacgacaccaaccgcggcgucacggccgccugcccgcacgccggcaccaacuccuucuaccggaaccucaucuggcuggugaagaaggggaacagcuaccccaagaucaacaaguccuacaucaacaacaaggagaaggaggugcugguccucugggccauccaccaccccucgaccuccgcggaccagcagagccuguaccagaacgccgacgccuacguguucgugggcucgucccgcuacagccggaaguucgagcccgagaucgccacccgcccgaagguccgggaccaggccgggcgcaugaacuacuacuggacgcugguggagcccggcgacaagaucaccuucgaggcgaccggcaaccucguggucccccgguacgccuucgcccugaagcgcaacuccgggucgggcaucaucaucuccgacaccagcgugcacgacugcgacacgaccugccagacccccaacggggccaucaacaccucccugccguuccagaacauccaccccgugacgaucggcgagugccccaaguacgucaagucgaccaagcuccggauggccaccggccugcgcaacauccccuccauccagagccgggggcuguucggcgcgaucgccggguucaucgagggcggguggaccggcaugaucgacggcugguacggguaccaccaccagaacgagcagggcuccggguacgccgccgaccucaagucgacgcagaacgccaucgacggcaucaccaacaaggugaacuccgugaucgagaagaugaacacccaguucaccgcggucgggaaggaguucagccaccuggagcgccggaucgagaaccugaacaagaagguggacgacggcuuccucgacaucuggacguacaacgccgagcugcugguccuccuggagaacgagcgcacccuggacuaccacgacuccaacgugaagaaccucuacgagaaggugcggucgcagcugaagaacaacgccaaggagaucggcaacgggugcuucgaguucuaccacaagugcgacgacacgugcauggaguccgucaagaacggcaccuacgacuacccgaaguacagcgaggaggccaagcugaaccgcgaggagaucgacggggugaagcucgaguccacccggaucuaccagauccuggccaucuacucgaccguggcgagcucccugguccucguggugucgcugggcgccaucuccuucuggaugugcagcaacgggucccugcagugccgcaucugcaucuga

SEQ ID NO: 99 - RNA, 1701 nt, Artificial Sequence
  derived and/or modified CDS sequence (AUadapt) from InfluenzaA__EPI482788__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagucgcucuccaccgccagcuccuggucguacaucguggagacguccaacagcgacaacgggaccugcuaccccggcgacuucaucaacuacgaggagcugcgcgagcagcuguccucgguguccagcuucgagcgguucgagaucuuccccaagaccuccucguggcccaaccacgacaccaaccgcggcgucacggccgccugcccgcacgccggcaccaacuccuucuaccggaaccucaucuggcuggugaagaaggggaacagcuaccccaagaucaacaaguccuacaucaacaacaaggagaaggaggugcugguccucugggccauccaccaccccucgaccuccgcggaccagcagagcaucuaccagaacgccgacgccuacguguucgugggcucgucccgcuacagccggaaguucgagcccgagaucgccacccgcccgaagguccgggaccaggccgggcgcaugaacuacuacuggacgcugguggagcccggcgacaagaucaccuucgaggcgaccggcaaccugguggucccccgguacgccuucgcccucaagcgcaacuccgggucgggcaucaucaucuccgacaccagcgugcacgacugcgacacgaccugccagacccccaacggggccaucaacaccucccugccguuccagaacauccaccccgugacgaucggcgagugccccaaguacgucaagucgaccaagcugcggauggccaccggccuccgcaacauccccuccauccagagccgggggcuguucggcgcgaucgccggguucaucgagggcggguggaccggcaugaucgacggcugguacggguaccaccaccagaacgagcagggcuccggguacgccgccgaccucaagucgacgcagaacgccaucgacggcaucaccaacaaggugaacuccgugaucgagaagaugaacacccaguucaccgcggucgggaaggaguucagccaccuggagcgccggaucgagaaccugaacaagaagguggacgacggcuuccuggacaucuggacguacaacgccgagcuccugguccugcucgagaacgagcgcacccuggacuaccacgacuccaacgugaagaaccuguacgagaaggugcggucgcagcucaagaacaacgccaaggagaucggcaacgggugcuucgaguucuaccacaagugcgacgacacgugcauggaguccgucaagaacggcaccuacgacuacccgaaguacagcgaggaggccaagcugaaccgcgaggagaucgacggggugaagcuggaguccacccggaucuaccagauccucgccaucuacucgaccguggcgagcucccugguccugguggugucgcucggcgccaucuccuucuggaugugcagcaacgggucccugcagugccgcaucugcaucuga

SEQ ID NO: 100 - RNA, 1701 nt, Artificial Sequence
  derived and/or modified CDS sequence (AUadapt) from InfluenzaA__EPI178946/m1__HA
augaaggccaucaucgugguccugcucuacaccuucgccaccgcggacgccgacacgcugugcaucggcuaccacgccaacaacucgaccgacaccguggacaccgugcuggagaagaacgucacggugacccacuccgugaaccuccuggagaacaagcacgacgggaagcugugcaagcuccgcggcgucgcgccccugcaccuggggaagugcaacaucgccggcuggcuccuggggaacccggagugcgagucgcuguucaccgccuccagcugguccuacaucguggagacccccaacucggacaacggcacgugcuaccccggcgacuucaucaacuacgaggagcuccgggagcaccuguccucgguguccagcuucgagcgcuucgagaucuuccccaaggccaacuccuggccgaaccacgacaccaacaagggggucaccgccgccugccccuacgcgggcgccaacucguucuaccggaaccugaucuggcucgugaagaaggggaacuccuaccccaagcugagcaaguccuacaucaacaacaagaagaaggaggugcuggucaucuggggcauccaccacccgcccaccucgacggaccagcagacccucuaccagaacgccgacgccuacguguucgugggguccucgaaguacuccaagcgcuucaagcccgagaucgccgcgcggcccaagguccgcaaccaggccggccggaugaacuacuacuggacccugaucgagcccggcgacaccaucacguucgaggccaccgggaaccugguggugccgcgcuacgccuucgccaugaagcggggcagcgggucgggcaucaucgucuccgacgcgcccgugcacgacugcaacacgaccugccagacccccaagggcgccaucaacaccagccuccccuuccagaacauccacccggugaccaucggggagugccccaaguacgucaaguccaccaagcugcgcauggccacgggccugcggaacauccccucgauccagucccgcggccucuucggggccaucgccggguuccuggagggcggcuggaccgggaugaucgacggcugguacggguaccaccaccagaacgagcagggcucgggguacgcggccgaccagaaguccacccagaacgccaucgacggcaucaccaacaaggugaacagcaucaucgagaagaugaacacgcaguucaccgccgugggcaaggaguucaaccagcuggagaagcggaucgagucccucaacaacaaggucgacgacggguuccuggacaucuggaccuacaacgccgagaugcuggugcuccuggagaacgagcgcacccuggacuaccacgacucgaacgucaagaaccucuacgagaaggugcggucccagcugaagaacaacgcgaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggucaagcucgagucggcccggaucuaccagauccuggccaucuacuccaccguggcgucgucccuggugcuccuggucagccugggcgccguguccuucuggaugugcucgaacggcagccuccagugccgcaucugcaucuga

SEQ ID NO: 101 - RNA, 1701 nt, Artificial Sequence
  derived and/or modified CDS sequence (AUadapt) from InfluenzaA__EPI482791/m2__HA
augaaggccaucaucgugguccugcucuacaccuucgccaccgcggacgccgacacgcugugcaucggcuaccacgccaacaacucgaccgacaccguggacaccgugcuggagaagaacgucacggugacccacuccgugaaccuccuggagaacaagcacgacgggaagcugugcaagcuccgcggcgucgcgccccugcaccuggggaagugcaacaucgccggcuggcuccuggggaacccggagugcgagucgcuguucaccgccuccagcugguccuacaucguggagacccccaacucggacaacggcacgugcuaccccggcgacuucaucaacuacgaggagcuccgggagcaccuguccucgguguccagcuucgagcgcuucgagaucuuccccaaggccaacuccuggccgaaccacgagaccaacaagggggucaccgccgccugccccuacgcgggcgccaacucguucuaccggaaccugaucuggcucgugaagaaggggaacuccuaccccaagcugagcaaguccuacaucaacaacaagaagaaggaggugcuggucaucuggggcauccaccacccgcccaccucgacggaccagcagacccucuaccagaacgccgacgccuacguguucgugggguccucgaaguacuccaagcgcuucaagcccgagaucgccgcgcggcccaagguccgcaaccaggccggccggaugaacuacuacuggacccugaucgagcccggcgacaccaucacguucgaggccaccgggaaccugguggugccgcgcuacgccuucgccaugaagcggggcagcgggucgggcaucaucgucuccgacgcgcccgugcacgacugcaacacgaccugccagacccccaagggcgccaucaacaccagccuccccuuccagaacauccacccggugaccaucggggagugccccaaguacgucaaguccaccaagcugcgcauggccacgggccugcggaacauccccucgauccagucccgcggccucuucggggccaucgccggguuccuggagggcggcuggaccgggaugaucgacggcugguacggguaccaccaccagaacgagcagggcucgggguacgcggccgaccagaaguccacccagaacgccaucgacggcaucaccaacaaggugaacagcaucaucgagaagaugaacacgcaguucaccgccgugggcaaggaguucaaccagcuggagaagcggaucgagucccucaacaacaaggucgacgacggguuccuggacaucuggaccuacaacgccgagaugcuggugcuccuggagaacgagcgcacccuggacuaccacgacucgaacgucaagaaccucuacgagaaggugcggucccagcugaagaacaacgcgaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggucaagcucgagucggcccggaucuaccagauccuggccaucuacuccaccguggcgucgucccuggugcuccuggucagccugggcgccguguccuucuggaugugcucgaacggcagccuccagugccgcaucugcaucuga

SEQ ID NO: 102 - RNA, 1701 nt, Artificial Sequence
  derived and/or modified CDS sequence (AUadapt) from InfluenzaA__EPI291799__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagucgcucuccaccgccagcuccuggucguacaucguggagacguccaacagcgacaacgggaccugcuaccccggcgacuucaucaacuacgaggagcugcgcgagcagcuguccucgguguccagcuucgagcgguucgagaucuuccccaagaccuccucguggcccaaccacgacaccaaccgcggcgucacggccgccugcccgcacgccggcaccaacuccuucuaccggaaccucaucuggcuggugaagaaggggaacagcuaccccaagaucaacaaguccuacaucaacaacaaggagaaggaggugcugguccucugggccauccaccaccccucgaccuccgcggaccagcagagccuguaccagaacgccgacgccuacguguucgugggcucgucccgcuacagccggaaguucgagcccgagaucgccacccgcccgaagguccgggaccaggccgggcgcaugaacuacuacuggacgcugguggagcccggcgacaagaucaccuucgaggcgaccggcaaccucguggucccccgguacgccuucgcccugaagcgcaccuccgggucgggcaucaucaucuccgacacgagcgugcacgacugcgacacgaccugccagacccccaacggggccaucaacaccucccugccguuccagaacauccaccccgugaccaucggcgagugccccaaguacgucaagucgaccaagcuccggauggccaccggccugcgcaacauccccuccauccagagccgggggcuguucggcgcgaucgccggguucaucgagggcggguggacgggcaugaucgacggcugguacggguaccaccaccagaacgagcagggcuccggguacgccgccgaccucaagucgacccagaacgccaucgacggcaucaccaacaaggugaacuccgugaucgagaagaugaacacccaguucacggcggucgggaaggaguucagccaccuggagcgccggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggucgcagcugaagaacaacgccaaggagaucggcaacgggugcuucgaguucuaccacaagugcgacgacacgugcauggaguccgucaagaacggcaccuacgacuacccgaaguacagcgaggaggccaagcugaaccgcgaggagaucgacggggugaagcucgaguccacccggaucuaccagauccuggccaucuacucgaccguggcgagcucccugguccucguggugucgcugggcgccaucuccuucuggaugugcagcaacgggucccugcagugccgcaucugcaucuga

SEQ ID NO: 103 - RNA, 1701 nt, Artificial Sequence
  derived and/or modified CDS sequence (AUadapt) from InfluenzaA__EPI482799__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagucgcucuccaccgccagcuccuggucguacaucguggagacguccaacagcgacaacgggaccugcuaccccggcgacuucaucaacuacgaggagcugcgcgagcagcuguccucgguguccagcuucgagcgguucgagaucuuccccaagaccuccucguggcccaaccacgagaccaaccgcggcgucacggccgccugcccgcacgccggcaccaacuccuucuaccggaaccucaucuggcuggugaagaaggggaacagcuaccccaagaucaacaaguccuacaucaacaacaaggagaaggaggugcugguccucugggccauccaccaccccucgaccuccgcggaccagcagagccuguaccagaacgccgacgccuacguguucgugggcucgucccgcuacagccggaaguucgagcccgagaucgccacccgcccgaagguccgggaccaggccgggcgcaugaacuacuacuggacgcugguggagcccggcgacaagaucaccuucgaggcgaccggcaaccucguggucccccgguacgccuucgcccugaagcgcaccuccgggucgggcaucaucaucuccgacacgagcgugcacgacugcgacacgaccugccagacccccaacggggccaucaacaccucccugccguuccagaacauccaccccgugaccaucggcgagugccccaaguacgucaagucgaccaagcuccggauggccaccggccugcgcaacauccccuccauccagagccgggggcuguucggcgcgaucgccggguucaucgagggcggguggacgggcaugaucgacggcugguacggguaccaccaccagaacgagcagggcuccggguacgccgccgaccucaagucgacccagaacgccaucgacggcaucaccaacaaggugaacuccgugaucgagaagaugaacacccaguucacggcggucgggaaggaguucagccaccuggagcgccggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggucgcagcugaagaacaacgccaaggagaucggcaacgggugcuucgaguucuaccacaagugcgacgacacgugcauggaguccgucaagaacggcaccuacgacuacccgaaguacagcgaggaggccaagcugaaccgcgaggagaucgacggggugaagcucgaguccacccggaucuaccagauccuggccaucuacucgaccguggcgagcucccugguccucguggugucgcugggcgccaucuccuucuggaugugcagcaacgggucccugcagugccgcaucugcaucuga

SEQ ID NO: 104 - RNA, 1701 nt, Artificial Sequence
  derived and/or modified CDS sequence (AUadapt) from InfluenzaA__EPI291807__HA
augaaggccaucaucgugguccugcucuacaccuucgccaccgcggacgccgacacgcugugcaucggcuaccacgccaacaacucgaccgacaccguggacaccgugcuggagaagaacgucacggugacccacuccgugaaccuccuggagaacaagcacgacgggaagcugugcaagcuccgcggcgucgcgccccugcaccuggggaagugcaacaucgccggcuggcuccuggggaacccggagugcgagucgcuguucgccgccuccagcugguccuacaucguggagacccccaacucggacaacgggaccugcuaccccggcgacuucaucaacuacgaggagcuccgggagcaccuguccagcguguccucguucgagcgcuucgagaucuuccccaaggccaacuccuggccgaaccacgacacgaacaagggggucaccgccgcgugccccuacgccggcgccaacagcuucuaccggaaccugaucuggcucgugaagaaggggaacuccuaccccaagcugucgaaguccuacaucaacaacaagaagaaggaggugcuggucaucuggggcauccaccacccgcccaccucgaccgaccagcagacgcucuaccagaacgccgacgccuacguguucgugggguccagcaaguacuccaagcgcuucaagcccgagaucgcggcccggcccaagguccgcgaccaggccggccggauggacuacuacuggacccugaucgagcccggcgacaccaucaccuucgaggccacggggaaccugguggugccgcgcuacgccuucgcgaugaagcggggcucggggagcggcaucaucgucuccgacgcccccgugcacgacugcaacacgaccugccagacccccaagggcgccaucaacaccucgcuccccuuccagaacauccacccggugaccaucggggagugccccaaguacgucaaguccaccaagcugcgcauggccaccggccugcggaacauccccagcauccagucccgcggccucuucggcgccaucgcgggguucaucgagggcggcuggacggggaugaucgacggcugguacggguaccaccaccagaacgagcagggcucgggguacgccgccgaccagaaguccacccagaacgccaucgacggcaucaccaacaaggugaacucgaucaucgagaagaugaacacccaguucacggccgugggcaaggaguucucccagcuggagaagcggaucgagagccugaacaacaaggucgacgacggguuccucgacaucuggaccuacaacgcggagcugcuggugcuccuggagaacgagcgcacccuggacuaccacgacuccaacgucaagaaccucuacgagaaggugcggucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggucaagcucgaguccgcccggaucuaccagauccuggcgaucuacucgaccguggccuccagccuggugcuccuggucucccugggcgccgugucguucuggaugugcagcaacggcucccuccagugccgcaucugcaucuga

SEQ ID NO: 105 - RNA, 1701 nt, Artificial Sequence
  derived and/or modified CDS sequence (AUadapt) from InfluenzaA__EPI638970__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggauccuggggaacccggagugcgagagccuguccaccgccucguccuggagcuacaucguggagacguccaacucggagaacgggaccugcuaccccggcgacuucaucaacuacgaggagcuccgcgagcagcuguccagcguguccucguucgagcgguucgagaucuuccccaagaccuccagcuggcccaaccacgacaccaacaagggcgucacggccgccugcccgcacuccggcaccaacucguucuaccgcaaccugguguggcucgugcagaaggggaacuccuaccccaagaucaacaagagcuacaucaacaacaaggagaacgagguccuggugcugugggccauccaccaccccuccaccucggccgaccagcagagccucuacaagaacgcggacgccuacguguucgucggcuccucgcgguacucccgcaaguucgagcccgagaucgccacccggccgaaggugcgcgaccaggccgggcggaugaacuacuacuggacgcugguggagcccggcgacaagaucaccuucgaggccaccggcaaccuggucgcgccccgcuacgccuucacccucaagcggaacagcggguccggcaucaucaucucggacacguccgugcacgacugcgacacgaccugccagacccccaacggggccaucaacaccagccugccguuccagaacauccaccccgugaccaucggcgagugccccaaguacgucaaguccaccaagcugcgcauggccaccggccuccggaacauccccucgauccagucccgcgggcuguucggcgccaucgcgggguucaucgagggcggguggacgggcaugaucgacggcugguacggguaccaccaccagaacgagcagggcagcggguacgccgccgaccugaaguccacccagaacgccaucgacggcaucaccaacaaggugaacucggugaucgagaagaugaacacccaguucacggccgucgggaaggaguucucccaccucgagcggcgcaucgagaaccugaacaagaagguggacgacggcuuccuggacaucuggaccuacaacgcggagcuccugguccugcucgagaacgagcggacccuggacuaccacgacagcaacgugaagaaccuguacgagaaggugcgcucccagcucaagaacaacgccaaggagaucggcaacgggugcuucgaguucuaccacaagugcgacgacaugugcauggagucggucaagaacggcaccuacgacuacccgaaguacuccgaggaggccaagcugaaccgggaggagaucgacggggugaagcuggagagcacgaagaucuaccagauccucgccaucuacucgaccguggccuccagccugguccugguggugucccucggcgcgaucucguucuggaugugcuccaacgggagccugcagugccgcaucugcaucuga

SEQ ID NO: 106 - RNA, 1701 nt, Artificial Sequence
  derived and/or modified CDS sequence (AUadapt) from InfluenzaA__ABI19015__HA
augaaggccaucaucgugguccugcucuacaccuucgccaccgcggacgccgacacgcugugcaucggcuaccacgccaacaacucgaccgacaccguggacaccgugcuggagaagaacgucacggugacccacuccgugaaccuccuggagaacaagcacgacgggaagcugugcaagcuccgcggcaucgcgccccugcaccuggggaagugcaacaucgccggcuggauccucgggaacccggagugcgagucgcuguucaccaccuccagcugguccuacaucgucgagacgcccaacucggacaacgggaccugcuaccccggcgacuucaucaacuacgaggagcugcgggagcaccucuccagcguguccucguucgagcgcuucgagaucuuccccaaggccaacuccuggccguaccacgacaccaacaagggcgugaccgccgccugccccuacgccggcgcgaacagcuucuaccggaaccugaucuggcuggucaagaaggggaacuccuaccccaagcucucgaaguccuacaucaacaacaagaagaaggaggugcuggugaucuggggcauccaccacccgcccacgagcaccgaccagcagacccuguaccagaacgccgacgccuacgucuucgugggguccucgaaguacuccaagcgcuucaagcccgagaucgccgcccggcccaaggugcgcgaccaggcgggccggauggacuacuacuggacccucaucgagcccggcgacacgaucaccuucgaggccaccgggaaccuggucgugccgcgcuacgccuucaccaugaagcggggcagcgggucgggcaucaucguguccgacgcccccguccacgacugcaacacgaccugccagacccccaagggcgccaucaacaccagccugcccuuccagaacauccacccggugacgaucggggagugccccaaguacgugaaguccaccaagcuccgcauggcgaccggccugcggaacauccccucgauccagucccgcgggcuguucggcgccaucgccggguucaucgagggcggcuggaccgggaugaucgacggcugguacggguaccaccaccagaacgagcagggcagcggguacgccgccgaccagaaguccacgcagaacgcgaucgacggcaucaccaacaaggucaacucgaucaucgagaagaugaacacccaguucaccgccgugggcaaggaguucucccagcucgagaagcggaucgagagccugaacaacaagguggacgacggguuccuggacaucuggacguacaacgccgagcuccugguccugcucgagaacgagcgcacccuggacuaccacgacuccaacgugaagaaccuguacgagaagguccggucgcagcucaagaacaacgccaaggagaucggcaacgggugcuucgaguucuaccacaagugcgacgacacgugcauggaguccgugaagaacggcaccuacgacuaccccaaguacagcgaggaggccaagcugaaccgccaggagaucgacggggugaagcuggaguccgcgcggaucuaccagauccucgccaucuacucgaccgucgccuccagccuggugcugcucgugucccugggcgccgucucguucuggaugugcagcaacggcucccugcagugccgcaucugcaucuga

SEQ ID NO: 107 - RNA, 1701 nt, Artificial Sequence
  derived and/or modified CDS sequence (AUadapt) from InfluenzaA__EPI687790__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugggcggggucgcgccccugcaccucggcaagugcaacaucgccggguggauccugggcaacccggagugcgagucgcuguccaccgccucguccuggagcuacaucguggagacguccaacucggacaacgggaccugcuaccccggcgacuucaucaacuacgaggagcuccgcgagcagcuguccucgguguccagcuucgagcgguucgagaucuuccccaagaccuccucguggcccaaccacgacuccaacaagggcgucaccgccgccugcccgcacgccggggccaagucguucuacaagaaccugaucuggcucgugaagaagggcaacuccuaccccaagcugaaccagagcuacaucaacgacaaggggaaggaggugcugguccucuggggcauccaccaccccuccacgaccgcggaccagcagucgcuguaccagaacgccgacgccuacguguucgugggcaccucgcgcuacuccaagaaguucaagcccgagaucgccacccggccgaagguccgcgaccaggaggggcggaugaacuacuacuggacgcugguggagcccggcgacaagaucaccuucgaggccaccgggaaccucguggucccccgcuacgcguucaccauggagcggaacgccggcucgggcaucaucaucuccgacacgcccgugcacgacugcaacacgaccugccagaccccggagggggccaucaacaccagccugcccuuccagaacauccaccccaucaccaucggcaagugccccaaguacgugaaguccaccaagcugcgccucgccaccgggcugcggaacgucccgucgauccagucccgcggccuguucggggccaucgcgggcuucaucgagggcggguggacgggcaugguggacgggugguacggcuaccaccaccagaacgagcaggggucgggcuacgccgccgaccucaaguccacccagaacgccaucgacaagaucaccaacaaggugaacagcgucaucgagaagaugaacacccaguucacggccgugggcaaggaguucaaccaccuggagaagcggaucgagaaccugaacaagaaggucgacgacggguuccucgacaucuggaccuacaacgcggagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgagaagaucgacggggugaagcucgagucgacccggaucuaccagauccuggccaucuacuccaccgucgccagcucccuggugcucguggucucgcugggcgcgaucuccuucuggaugugcucgaacggcagccugcagugccgcaucugcaucuga

SEQ ID NO: 108 - RNA, 1701 nt, Artificial Sequence
  derived and/or modified CDS sequence (AUadapt) from InfluenzaA__EPI841265__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugggcggggucgcgccccugcaccucggcaagugcaacaucgccggguggauccugggcaacccggagugcgagucgcuguccaccgccucguccuggagcuacaucguggagacguccaacucggacaacgggaccugcuaccccggcgacuucaucaacuacgaggagcuccgcgagcagcuguccucgguguccagcuucgagcgguucgagaucuuccccaagaccuccucguggcccaaccacgacuccaacaagggcgucaccgccgccugcccgcacgccggggccaagucguucuacaagaaccugaucuggcucgugaagaagggcaacuccuaccccaagcugaaccagagcuacaucaacgacaaggggaaggaggugcugguccucuggggcauccaccaccccuccacgaccgcggaccagcagucgaucuaccagaacgccgacgccuacguguucgugggcaccucgcgcuacuccaagaaguucaagcccgagaucgccacccggccgaagguccgcgaccaggaggggcggaucaacuacuacuggacgcugguggagcccggcgacaagaucaccuucgaggccaccgggaaccugguggucccccgcuacgcguucaccauggagcggaacgccggcucgggcaucaucaucuccaacacgcccgugcacgacugcaacacgaccugccagaccccggagggggccaucaacaccagccuccccuuccagaacauccaccccaucaccaucggcaagugccccaaguacgugaaguccaccaagcugcgccuggccaccgggcuccggaacgucccgucgauccagucccgcggccuguucggggccaucgcgggcuucaucgagggcggguggacgggcaugguggacgggugguacggcuaccaccaccagaacgagcaggggucgggcuacgccgccgaccugaaguccacccagaacgccaucgacaagaucaccaacaaggugaacagcgucaucgagaagaugaacacccaguucacggccgugggcaaggaguucaaccaccucgagaagcggaucgagaaccugaacaagaaggucgacgacggguuccuggacaucuggaccuacaacgcggagcuccuggugcugcucgagaacgagcgcacccuggacuaccacgacuccaacgugaagaaccuguacgagaagguccggaaccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgcgagaagaucgacggggugaagcuggagucgacccggaucuaccagauccucgccaucuacuccaccgucgccagcucccuggugcugguggucucgcucggcgcgaucuccuucuggaugugcucgaacggcagccugcagugccgcaucugcaucuga

SEQ ID NO: 109 - RNA, 1701 nt, Artificial Sequence
  derived and/or modified CDS sequence (AUadapt) from InfluenzaA__EPI291846__HA
augaaggccaucaucgugguccugcucuacaccuucgccaccgcggacgccgacacgcugugcaucggcuaccacgccaacaacucgaccgacaccguggacaccgugcuggagaagaacgucacggugacccacuccgugaaccuccuggagaacaagcacgacgggaagcugugcaaccucaagggcgucgcgccccugcaccuggggaagugcaacaucgccggcuggcuccuggggaacccggagugcgagucgcuguucaccgccuccagcugguccuacaucguggagacccccaacucggacaacggcacgugcuaccccggcgacuucaucaacuacgaggagcuccgcgagcaccuguccagcguguccucguucgagcgguucgagaucuuccccaaggucaacuccuggccgaaccacgacaccaacaagggggugaccgccgccugccccuacgccggcgcgaacagcuucuaccgcaaccugaucuggcucgugaagaaggggaacuccuaccccaagcugucgaaguccuacaucaacaacaagaagaaggagguccuggugaucuggggcauccaccacccgcccaccagcacggaccagcagacccucuaccagaacgccgacgccuacguguucgucggguccucgaaguacuccaagcgguucgagcccgagaucgccgcccgccccaaggugcggaaccaggcgggccgcaugaacuacuacuggacccugaucgagcccggcgacaccaucacguucgaggccaccgggaaccugguggucccgcgguacgccuucgccaugcgccggggcagcgggucgggcaucaucguguccgacgcccccgugcacgacugcaacacgaccugccagacccccaagggcgcgaucaacaccagccuccccuuccagaacauccacccggucaccaucggggagugccccaaguacgugaaguccaccaagcugcgcauggccacgggccugcggaacauccccucgauccagucccgcggccucuucggggccaucgccggguuccuggagggcggcuggaccgggaugaucgacggcugguacggguaccaccaccagaacgagcagggcagcggguacgccgcggaccagaaguccacccagaacgccaucgacggcaucaccaacaaggugaacucgaucaucgagaagaugaacacgcaguucaccgccgucggcaaggaguucucccagcuggagaagcggaucgagagccucaacaacaagguggacgacggguuccuggacaucuggaccuacaacgccgagaugcugguccuccuggagaacgagcgcacccuggacuaccacgacuccaacgugaagaaccucuacgagaaggugcggucgcagcugaagaacaacgccaaggagaucggcaacgggugcuucgaguucuaccacaagugcgacaacacgugcauggaguccguccgcaacggcaccuacgacuaccccaaguacagcgaggaggcgaagcugaaccgggaggagaucgacggggugaagcucgaguccgcccgcaucuaccagauccuggccaucuacucgaccguggccuccagccugguccuccuggugucccugggcgcggugucguucuggaugugcagcaacggcucccuccagugccggaucugcaucuga

SEQ ID NO: 110 - RNA, 1695 nt, Artificial Sequence
  derived and/or modified CDS sequence (AUadapt) from InfluenzaA__EPI558121__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagucgcucuccaccgccagcuccuggucguacaucguggagacguccaacagcgacaacgggaccugcuaccccggcgacuucaucaacuacgaggagcugcgcgagcagcuguccucgguguccucguucgagcgguucgagaucuucccccagaccuccagcuggcccaaccacgacaccaaccgcggcgucacggccgccugcccgcacgccggcaccaacuccuucuaccggaaccucguguggcuggugaagaaggggaacucguacuccaagaucaacaagagcuacaucaacaacaaggagaaggagguccuggugcucugggccauccaccaccccuccaccucggcggaccagcagagccuguaccagaacgccgacgccuacguguucgucggcuccucgcgcuacucccggaaguucgagcccgagaucgccacccgccccaaggugcgggaccaggccgggcgcaugaacuacuacuggacgcugguggagccgggcgacaagaucaccuucgaggcgaccggcaaccucgucgcgccccgguacgccuucgcccugaagcgcaacucgggguccggcaucaucaucagcgacaccuccgugcacgacugcgacacgaccugccagacccccaacggggccaucaacaccucgcugcccuuccagaacauccacccggugacgaucggcgagugccccaaguacgucaaguccaccaagcuccggauggccaccggccugcgcaacauccccagcauccagucccgggggcuguucggcgccaucgccggguucaucgagggcggguggaccggcaugaucgacggcugguacggguaccaccaccagaacgagcagggcucgggguacgccgccgaccucaaguccacgcagaacgcgaucgacggcaucaccaacaaggugaacagcgugaucgagaagaugaacacccaguucaccgccgucgggaaggaguucucccaccuggagcgccggaucgagaaccugaacaagaagguggacgacggcuuccucgacaucuggacguacaacgccgagcugcugguccuccuggagaacgagcgcacccuggacuaccacgacucgaacgugaagaaccucuacgagaaggugcggucccagcugaagaacaacgccaaggagaucggcaacgggugcuucgaguucuaccacaagugcgacgacaugugcauggagucggucaagaacggcaccuacgacuaccccaaguacuccgaggaggccaagcugaaccgcgaggagaucgacggggugaagcucgagagcacccggaucuaccagauccuggcgaucuacucgacgguggccuccagccugguccucguggugucccugggcgccaucucguucuggaugugcuccaacgggagccugcagugccgcaucuga

SEQ ID NO: 111 - RNA, 1701 nt, Artificial Sequence; identical to SEQ ID NO: 68
  derived and/or modified CDS sequence (AUadapt) from InfluenzaA__EPI564139__HA

SEQ ID NO: 112 - RNA, 1701 nt, Artificial Sequence; identical to SEQ ID NO: 59
  derived and/or modified CDS sequence (AUadapt) from InfluenzaA__EPI786706__HA

SEQ ID NO: 113 - RNA, 1701 nt, Artificial Sequence
  derived and/or modified CDS sequence (AUadapt) from InfluenzaA__EPI395313__HA
augaaggccauccugaucgugcuccuguacaccuucaccacggccaacgcggacacccugugcaucggcuaccacgccaacaacucgaccgacaccgucgacacggugcucgagaagaacgugaccgucacccacuccgugaaccugcuggagaaccgccacaacgggaagcucugcaagcugcggggcguggcgccccugcaccucgggaagugcaacaucgccggcuggcugcuggggaacccggagugcgagucgcucuccaccgccagcuccuggucguacaucgucgagacguccaacagcgacaacgggaccugcuaccccggcgacuucaucaacuacgaggagcugcgcgagcagcuguccucgguguccagcuucgagcgguucgagaucuuccccaagaccuccucguggcccaaccacgacaccaaccgcggcgugacggccgccugcccgcacgccggcaccaaguccuucuacaagaaccucaucuggaucgccaagaaggggaacucguaccccaagaucaacaaguccuacaucaacaacaaggagaaggagguccuggugcugugggcgauccaccaccccagcaccuccgccgaccagcagucgcucuaccagaacgccgacgccuacguguucgucggcagcucccgguacucgcgcaaguucgagcccgagaucgccacccggccgaaggugcgcgaccaggcggggcggaugaacuacuacuggacgcugguggagcccggcgacaagaucaccuucgaggccaccggcaaccuggucgcgccccgcuacgccuucgcccucaagcggaacuccgggagcggcaucaucaucuccgacaccucggugcacgacugcgacacgaccugccagacccccaacggggccaucaacaccucccugccguuccagaacauccaccccgugacgaucggcgagugccccaaguacgucaagagcaccaagcugcgcauggccaccggccuccggaacauccccuccauccagucgcgcgggcuguucggcgccaucgccggguucaucgagggcggguggaccggcaugaucgacggcugguacggguaccaccaccagaacgagcagggcuccggguacgccgcggaccucaagucgacgcagaacgccaucgacggcaucaccaacaaggugaacuccgugaucgagaagaugaacacccaguucaccgccgucgggaaggaguucagccaccuggagcggcgcaucgagaaccugaacaagaagguggacgacggcuuccuggacaucuggacguacaacgccgagcuccuggugcugcucgagaacgagcggacccuggacuaccacgacuccaacgucaagaaccuguacgagaaggugcgcucgcagcucaagaacaacgccaaggagaucggcaacgggugcuucgaguucuaccacaagugcgacgacaugugcauggaguccgucaagaacggcaccuacgacuacccgaaguacagcgaggaggcgaagcugaaccgggaggugaucgacggggugaagcuggaguccacccgcaucuaccagauccucgccaucuacgccacggucgccucgagccuggugcugguggucucccucggcgcgaucucguucuggaugugcuccaacgggagccugcagugccggaucugcaucuga

SEQ ID NO: 114 - RNA, 1701 nt, Artificial Sequence
  derived and/or modified CDS sequence (AUadapt) from InfluenzaA__EPI291696__HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgagaaccgccacaacgggaagcugugcaagcugcggggcgugcccccgcuccaccuggggaagugcaacaucgccggcuggcugcucgggaaccccgagugcgagcugcuguucaccgccucguccuggagcuacaucgucgagaccuccaacucggacaacggcacgugcuaccccggcgacuucaucaacuacgaggagcuccgcgagcagcuguccagcguguccucguucgagcgguucgagaucuuccccaaggcguccagcuggccggaccacgagaccaaccgcggggugaccgccgccugccccuacgccggcgcgaacuccuucuaccggaaccugaucuggcucgucaagaaggggaacucguaccccaagcuguccaagagcuacgugaacaacaaggagaaggaggugcugguccucuggggcauccaccacccgcccaccuccacggaccagcagucgcuguaccagaacgccgacgccuacguguucgugggguccagcaaguacaacaagaaguucaagcccgagauggccgcccgccccaagguccggggccaggcgggccgcaugaacuacuacuggacccugguggcccccggggacaccaucaccuucgaggccacgggcaaccucguggucccgcgguacgccuucgccaugaagcgcgggucgggcuccggcaucaucaucucggacacccccgugcacgacugcaacacgaccugccagacccccaagggggcgaucaacaccucccugcccuuccagaacauccacccggugaccaucggcgagugccccaaguacgucaagagcaccaagcugcggauggccacggggcuccgcaacauccccuccauccagucgcggggccuguucggggccaucgccggcuucaucgagggcggguggaccggcaugaucgacgggugguacggcuaccaccaccagaacgagcagggguccggcuacgccgcggaccgcaagagcacccagaacgccaucgacggcaucaccaacaaggugaacuccgugaucgagaagaugaacacgcaguucaccgccgucgggaaggaguucaaccaccuggagaagcggaucgagaaccucaacaagaagguggacgacggcuuccuggacgucuggaccuacaacgccgagcugcucgugcugcuggagaacgagcgcacccucgacuaccacgacucgaacgugaagaaccuguacgagaagguccggucccagcugaagaacaacgccaaggagaucgggaacggcugcuucgaguucuaccacaagugcgacgacacgugcauggagagcgugaagaacgggaccuacgacuaccccaaguacuccgaggagucgaagcucaaccgcgaggagaucgacggcgugaagcuggaguccacccggaucuaccagauccuggcgaucuacagcaccgucgccuccucgcucgugcuguccgugagccugggcgccaucucguucuggaugugcuccaacgggagccuccagugccgcaucugcaucuga

SEQ ID NO: 115 - RNA, 1701 nt, Artificial Sequence
  derived and/or modified CDS sequence (AUadapt) from InfluenzaA__ACU80014__HA
augaaggccauccugcucgugcugcugugcaccuucgccgcgaccaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccggguggcugcucggcaacccggagugcgagcugcugcucaccgugagcuccuggucguacaucgucgagaccuccaacagcgacaacggcacgugcuaccccggggacuucaucaacuacgaggagcugcgggagcagcuguccucgguguccagcuucgagcgcuucgagaucuuccccaagaccuccucguggcccaaccacgagaccaaccggggcgugaccgccgccugcccguacgccggggccaacuccuucuaccgcaaccucaucuggcuggucgagaagggcaacagcuaccccaagcuguccaagucguacgugaacaacaaggggaaggaggugcucguccuguggggcauccaccacccgcccacguccaccgaccagcagagccuguaccagaacgcggacgccuacguguucgugggcuccucgaaguacaaccggaaguucaagcccgagaucgccgcccgccccaagguccgggggcaggccggccgcaugaacuacuacuggacccucaucgagcccggggacaccaucacguucgaggcgaccggcaaccugguggugccccgguacgccuucgccaugaaccgcggcagcggguccggcaucaucaucucggacgccccgguccacgacugcaacaccaagugccagacccccaagggggccaucaacacgucccugcccuuccagaacauccaccccgugaccaucggcgagugcccgaaguacgucaagagcaccaagcuccggauggcgaccgggcugcgcaacauccccuccauccagucgcggggccuguucggcgccaucgccggguucaucgagggcggguggacgggcaugaucgacgggugguacggcuaccaccaccagaacgagcagggcuccggguacgccgccgaccagcgcagcacccagaacgcgaucgacggcaucaccaacaaggugaacuccgugaucgagaagaugaacacccaguucacggccguggggaaggaguucaaccaccucgagaagcggaucgagaaccugaacaagaaggucgacgacggcuuccuggacaucuggaccuacaacgccgagcuccuggugcugcucgagaacgagcgcacccuggacuuccacgacucgaacgucaagaaccuguacgagaaggugcggucccagcuccgcaacaacgccaaggagaucgggaacggcugcuucgaguucuaccacaagugcgacgacacgugcauggagagcgugaagaacggcaccuacgacuaccccaaguacuccgaggagucgaagcugaaccgggaggagaucgacggggucaagcuggaguccacccgcaucuaccagauccucgccaucuacagcaccguggcguccucgcuggugcugcucgucucccugggcgccaucagcuucuggaugugcagcaacgggucccugcagugccggaucugcaucuga

SEQ ID NO: 116 - RNA, 1701 nt, Artificial Sequence
  derived and/or modified CDS sequence (AUadapt) from InfluenzaA__EPI177400__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 117 - RNA, 1701 nt, Artificial Sequence
  derived and/or modified CDS sequence (AUadapt) from InfluenzaA__ACT36512__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 118 - RNA, 1704 nt, Artificial Sequence
  derived and/or modified CDS sequence (AUadapt) from InfluenzaA__AJE30344__HA
auggagaagaucgugcugcuccuggccgucaucucgcuggugaaguccgaccagaucugcaucggcuaccacgccaacaacagcaccaagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggucguacaucguggagcgggccaaccccgccaacgaccugugcuaccccgggacccugaacgacuacgaggagcucaagcaccuccugucccgcaucaaccacuucgagaagaaccugaucaucccgcggagcuccuggcccaaccacgagacgucgcugggcgucuccgccgcgugccccuaccagggcgccagcuccuucuuccgcaacgugguguggcugaucaagaagaacgacgccuaccccaccaucaagaucucguacaacaacaccaaccgggaggaccuccugauccugugggggauccaccacuccaacaacgccgcggagcagaccaaccucuacaagaacccggacacguacgucagcgugggcaccuccacccugaaccagcgccuggugcccaagaucgccacccggucgcaggucaacgggcaguccggccgcauggacuucuucuggacgauccucaagcccaacgacgccauccacuucgagagcaacgggaacuucaucgcccccgaguacgccuacaagaucgugaagaagggcgacuccaccaucaugaaguccgagauggaguacggccacugcaacaccaagugccagaccccgaucggggcgaucaacucgagcaugcccuuccacaacauccacccccugacgaucggcgagugccccaaguacgucaagucgaacaagcuggugcucgccaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgcggacaaggagucgacccagaaggccaucgacggcgugaccaacaaggucaacuccaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuaccccaaguacucggaggaggcgauccucaagcgcgaggagaucuccggggugaagcuggagagcaucggcacguaccagauccuguccaucuacucgaccgucgccuccagccucgcccuggccaucaucguggccgggcugucccucuggaugugcagcaacggcucccugcagugccgcaucugcaucuga

SEQ ID NO: 119 - RNA, 1701 nt, Artificial Sequence; identical to SEQ ID NO: 98
  derived and/or modified CDS sequence (AUadapt) from InfluenzaA__EPI178948__HA

SEQ ID NO: 120 - RNA, 1701 nt, Artificial Sequence; identical to SEQ ID NO: 98
  derived and/or modified CDS sequence (AUadapt) from InfluenzaA__EPI178949__HA

SEQ ID NO: 121 - RNA, 1701 nt, Artificial Sequence
  derived and/or modified CDS sequence (AUadapt) from InfluenzaA__EPI590132__HA
augaaggccauccugaucgugcuccuguacaccuucaccacggccaacgcggacaagaucugcaucggcuaccacgccaacaacucgaccgacaccgucgacaccgugcuggagaagaacgugacggucacccacuccgugaaccuccuggagaacaagcacaacgggaagcugugcaagcuccgcggcguggcgccccugcaccuggggaagugcaacaucgccggcuggcuccuggggaacccggagugcgagucgcuggccaccgccuccagcugguccuacaucgucgagaccucguccagcaacaacggcacgugcuaccccggcgacuucaucaacuacgaggagcuccgggagcagcuguccucgguguccagcuucgagaaguucgagaucuuccccaagaccuccucguggcccaaccacgagaccaacaagggggugaccgccgccugcccgcacgccggcacgaacuccuucuacaagaaccugaucuggcucgucaagaaggagaacucguaccccaagaucaacaucuccuacaccaacaaccgcgggaaggaggugcuggugcugugggcgauccaccacccgcccaccagcaccgaccagcagucccucuaccagaacgccaacucguacgucuucgugggcagcucccgguacucgcgcaaguucgagcccgagaucgccacgcggcccaaggugcgcgggcaggccggccggaugaacuacuacuggacccuggucgagcccggcgacaagaucaccuucgaggccaccgggaaccugguggugccccgcuacgcguucgcccucaagcggaacuccggcagcgggaucaucaucuccgagacgccgguccacgacugcgacacgaccugccagacccccaacggcgccaucaacaccucgcugcccuuccagaacauccaccccgugaccaucggcgagugcccgaaguacgugaaguccaccaagcugcgcauggccaccgggcuccggaacauccccagcauccagucccgcggccuguucggggccaucgcgggcuucaucgagggcggguggacgggcaugaucgacgggugguacggcuaccaccaccagaacgagcaggggucgggcuacgccgccgaccugaaguccacccagaacgccaucgacgggaucaccaacaaggucaacucggugaucgagaagaugaacacccaguucacggccgugggcaaggaguucucccaccucgagcggcgcaucgagaaccugaacaagaaggucgacgacggcuucaucgacaucuggaccuacaacgcggagcugcucgugcugcuggagaacgagcggacccucgacuaccacgacagcaacgucaagacccuguacgagaaggugcgcucccagcugaagaacaacgccaaggagaucgggaacggcugcuucgaguucuaccacaagugcgacgacacgugcauggagucggugaagaacgggaccuacgacuaccccaaguacuccgaggaggccaagcucaaccgggaggagaucgacggcaucaagcuggagagcacccgcaucuaccagauccuggccaucuacuccaccgucgccucgagccucgugcugguggucucccugggggcgaucucguucuggaugugcuccaacggcagccuccagugccgggugugcaucuga

SEQ ID NO: 122 - RNA, 1701 nt, Artificial Sequence
  derived and/or modified CDS sequence (AUadapt) from InfluenzaA__ABU80400__HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugcggggcguggcgccccuccaccuggggaagugcaacaucgccggcuggcugcucgggaacccggagugcgagcugcuguucaccgccucguccuggagcuacaucgucgagaccuccaacucggacaacggcacgugcuaccccggcgacuucaucaacuacgaggagcuccgcgagcagcuguccagcguguccucguucgagcgguucgagaucuuccccaaggccuccagcuggcccaaccacgagaccaaccgcggggugaccgccgccugcccguacgcgggcgccaacuccuucuaccggaaccugaucuggcucgucaagaaggggaacucguaccccaagcuguccaagagcuacgugaacaacaaggagaaggaggugcugguccucuggggcauccaccacccgcccaccuccacggaccagcagucgcuguaccagaacgccgacgccuacguguucgugggguccagcaaguacaacaagaaguucaagcccgagaucgccacccgccccaagguccggggccaggcgggccgcaugaacuacuacuggacccugguggagcccggggacaccaucacguucgaggccaccggcaaccucguggucccccgguacgccuucgccaugaagcgcgggucgggcuccggcaucaucaucagcgacaccccggugcacgacugcaacaccacgugccagacccccaagggggccaucaacaccucccugcccuuccagaacauccaccccgugaccaucggcgagugcccgaaguacgucaagucgacgaagcugcggauggcgaccgggcuccgcaacauccccuccauccagagccggggccuguucggggccaucgccggcuucaucgagggcggguggaccggcaugaucgacgggugguacggcuaccaccaccagaacgagcagggguccggcuacgccgccgaccgcaagucgacccagaacgcgaucgacggcaucacgaacaaggugaacuccgugaucgagaagaugaacacccaguucaccgccgucgggaaggaguucaaccaccuggagaagcggaucgagaaccucaaccgcaagguggacgacggcuuccuggacaucuggaccuacaacgccgagcugcucguccugcuggagaacgagcggacgcucgacuaccacgacagcaacgugaagaaccuguacgagaaggugcgcucccagcugaagaacaacgccaaggagaucgggaacggcugcuucgaguucuaccacaagugcgacgacacgugcauggagucggucaagaacgggaccuacgacuaccccaaguacuccgaggagagcaagcucaaccgggaggagaucgacggcgugaagcuggaguccacccgcaucuaccagauccuggccaucuacucgaccguggcguccagccucguccugcuggugucccucggcgccaucucguucuggaugugcagcaacgggucccugcagugccggaucugcaucuga

SEQ ID NO: 123 - RNA, 1698 nt, Artificial Sequence
  derived and/or modified CDS sequence (AUadapt) from InfluenzaA__ABO21709__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacucgcacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugucguccgugagcuccuucgagcgguucgagaucuuccccaaggagucguccuggcccaaccacaacaccaacggggugaccgccgccugcagccacgagggcaaguccucguucuaccgcaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucucgguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggucgggcaucaucacguccaacgccagcaugcacgagugcaacaccaagugccagacgccccugggcgccaucaacuccucgcugcccuaccagaacauccacccggugaccaucggggagugccccaaguacgugcgguccgccaagcuccgcauggucaccggccugcggaacaaccccagcauccagucccgcgggcuguucggcgcgaucgccggguucaucgagggcggcuggaccgggaugaucgacggcugguacggguaccaccaccagaacgagcagggcucgggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagucgguccggaacggcacguacgacuaccccaaguacuccgaggagagcaagcugaaccgcgagaagguggacggggugaagcuggaguccaugggcaucuaccagauccucgccaucuacucgaccgucgccuccagccuggugcugcucgugucccugggcgcgaucucguucuggaugugcagcaacgggucccugcagugccggaucugcaucuga

SEQ ID NO: 124 - RNA, 1701 nt, Artificial Sequence; identical to SEQ ID NO: 62
  derived and/or modified CDS sequence (AUadapt) from InfluenzaA__CAZ65588__HA

SEQ ID NO: 125 - RNA, 1701 nt, Artificial Sequence; identical to SEQ ID NO: 59
  derived and/or modified CDS sequence (AUadapt) from InfluenzaA__EPI697744__HA

SEQ ID NO: 126 - RNA, 1701 nt, Artificial Sequence; identical to SEQ ID NO: 60
  derived and/or modified CDS sequence (AUadapt) from InfluenzaA__EPI768525__HA

SEQ ID NO: 127 - RNA, 1701 nt, Artificial Sequence
  derived and/or modified CDS sequence (AUadapt) from InfluenzaA__EPI726930__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccucguccuggagcuacaucguggagacguccaacucggacaacgggaccugcuaccccggcgacuucaucaacuacgaggagcuccgggagcagcuguccucgguguccagcuucgagcgcuucgagaucuuccccaaggcguccucguggcccaaccacgacuccaacaagggcgucaccgccgccugcccgcacgccggcgccaagucguucuacaagaaccugaucuggcucgugaagaaggggaacuccuaccccaagcugaaccagagcuacaucaacgacaagggcaaggaggugcugguccucugggggauccaccaccccuccaccacggccgaccagcagucgcuguaccagaacgccgacgccuacguguucgugggcaccucgcgguacuccaagaaguucaagcccgagaucgccacccgcccgaagguccgggaccaggagggccgcaugaacuacuacuggacccugguggagcccggggacaagaucacguucgaggcgaccggcaaccucguggucccccgguacgccuucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcucgggguacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagucgacccgcaucuaccagauccuggccaucuacuccaccgucgcgagcucccuggugcucguggucucgcugggggccaucuccuucuggaugugcucgaacggcagccugcagugccggaucugcaucuga

SEQ ID NO: 128 - RNA, 1701 nt, Artificial Sequence
  derived and/or modified CDS sequence (AUadapt) from InfluenzaA__EPI813817__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccucguccuggagcuacaucguggagacguccaacucggacaacgggaccugcuaccccggcgacuucaucaacuacgaggagcuccgggagcagcuguccucgguguccagcuucgagcgcuucgagaucuuccccaaggcguccucguggcccaaccacgacuccaacaagggggucaccgccgccugcccgcacgccggcgccaagucguucuacaagaaccugaucuggcucgugaagaaggggaacuccuaccccaagcugaaccagagcuacaucaacgacaagggcaaggaggugcugguccucugggggauccaccaccccuccaccacggccgaccagcagucgcuguaccagaacgccgacgccuacguguucgugggcaccucgcgguacuccaagaaguucaagcccgagaucgccacccgcccgaagguccgggaccaggaggcgcgcaugaacuacuacuggacccugguggagcccggcgacaagaucacguucgaggccaccgggaaccucguggucccccgguacgccuucaccauggagcgcaacgccggcucggggaucaucaucuccgacacccccgugcacgacugcaacacgaccugccagaccccggagggcgccaucaacaccagccugcccuuccagaacauccaccccaucacgaucggcaagugccccaaguacgugaaguccaccaagcugcggcucgcgaccgggcugcgcaacgucccgucgauccagucccggggccuguucggggccaucgccggcuucaucgagggcggcuggaccggcaugguggacgggugguacggcuaccaccaccagaacgagcaggggucgggcuacgccgccgaccucaaguccacgcagaacgcgaucgacaagaucaccaacaaggugaacagcgucaucgagaagaugaacacccaguucaccgccguggggaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggagaagaucgacggggugaagcucgagucgacccgcaucuaccagauccuggcgaucuacuccaccgucgccagcucccuggugcucguggucucgcugggcgccaucuccuucuggaugugcucgaacgggagccugcagugccggaucugcaucuga

SEQ ID NO: 129 - RNA, 1701 nt, Artificial Sequence
  derived and/or modified CDS sequence (AUadapt) from InfluenzaA__EPI466626__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucguccguggugcuggucgugagccucggggccaucucguucuggaugugcuccaacggcagccugcagugccggaucugcaucuga

SEQ ID NO: 130 - RNA, 1701 nt, Artificial Sequence
  derived and/or modified CDS sequence (AUadapt) from InfluenzaA__EPI541966__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgagucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucguccguggugcuggucgugagccucggggccaucucguucuggaugugcuccaacggcagccugcagugccggaucugcaucuga

SEQ ID NO: 131 - RNA, 1701 nt, Artificial Sequence
  derived and/or modified CDS sequence (AUadapt) from InfluenzaA__EPI652003__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgagucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccacccgcccaccacggccgaccagcagucgcuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacaccccggugcacgacugcaacaccacgugccagacccccgagggcgccaucaacaccucccugcccuuccagaacauccaccccaucaccaucgggaagugcccgaaguacgucaagucgacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgcguccagcguggugcuggucgugucccucggggccaucucguucuggaugugcagcaacggcucccugcagugccggaucugcaucuga

SEQ ID NO: 132 - RNA, 1701 nt, Artificial Sequence
  derived and/or modified CDS sequence (AUadapt) from InfluenzaA__EPI291877__HA
augaaggccaucaucgugguccugcucuacaccuucgccaccgcggacgccgacacgcugugcaucggcuaccacgccaacaacucgaccgacaccguggacaccgugcuggagaagaacgucacggugacccacuccgugaacauccucgagaacaagcacgacgggaagcugugcaagcugcgcggcgucgcgccccuccaccuggggaagugcaacaucgccggcuggcugcucgggaacccggagugcgagucgcuguucgccgccuccagcugguccuacaucguggagacccccaacucggacaacgggaccugcuaccccggcgacuucaucaacuacgaggagcugcgggagcaccucuccagcguguccucguucgagcgcuucgagaucuuccccaaggccaacuccuggccgaaccacgacacgaacaagggcgucaccgccgcgugccccuacgccggcgccaacagcuucuaccggaaccugaucuggcuggugaagaaggggaacuccuaccccaagcucucgaaguccuacaucaacaacaagaagaaggaggugcuggucaucuggggcauccaccacccgcccaccagcaucgaccagcagacccuguaccagaacgccgacgccuacguguucgugggguccucgaaguacuccaagcgcuucaagcccgagaucgcggcccggcccaagguccgcgaccaggccggccggauggacuacuacuggacgcucaucgagcccggcgacaccaucaccuucgaggccaccgggaaccugguggugccgcgcuacgccuucgcgaugaagcggggcagcgggucgggcaucaucgucuccgacgcccccgugcacgacugcaacacgaccugccagacccccaagggcgccaucaacaccagccugcccuuccagaacauccacccggugacgaucggggagugccccaaguacgucaaguccaccaagcuccgcauggccaccggccugcggaacauccccucgauccagucccgcgggcuguucggcgccaucgcgggguucaucgagggcggcuggaccgggaugaucgacggcugguacggguaccaccaccagaacgagcagggcagcggguacgccgccgaccagaaguccacgcagaacgccaucgacggcaucaccaacaaggugaacucgaucaucgagaagaugaacacccaguucaccgccgugggcaaggaguucucccagcucgagaagcggaucgagagccugaacaacaaggucgacgacggguuccuggacaucuggacguacaacgcggagcuccuggugcugcucgagaacgagcgcacccuggacuaccacgacuccaacgucaagaaccuguacgagaaggugcggucgcagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacgggaucaagcuggaguccgcccggaucuaccagauccucgcgaucuacucgaccgucgccuccagccuggugcugcucgugucccugggcgccgucucguucuggaugugcagcaacggcucccugcagugccgcaucugcaucuga

SEQ ID NO: 133 - RNA, 1701 nt, Artificial Sequence
  derived and/or modified CDS sequence (AUadapt) from InfluenzaA__ABR29595__HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugcggggcguggcgccccuccaccuggggaagugcaacaucgccggcuggcugcucgggaacccggagugcgagcugcuguucaccgccucguccuggagcuacaucgucgagaccuccaacucggacaacggcacgugcuaccccggcgacuucaucaacuacgaggagcuccgcgagcagcuguccagcguguccucguucgagcgguucgagaucuuccccaaggccuccagcuggcccaaccacgagaccaaccgcggggugaccgccgccugcccguacgcgggcgccaacuccuucuaccggaaccugaucuggcucgucaagaaggggaacucguaccccaagcuguccaagagcuacgugaacaacaaggagaaggaggugcugguccucuggggcauccaccacccgcccaccuccacggaccagcagucgcuguaccagaacgccgacgccuacguguucgugggguccagcaaguacaacaagaaguucaagcccgagaucgccacccgccccaagguccggggccaggcgggccgcaugaacuacuacuggacccugguggagcccggggacaccaucacguucgaggccaccggcaaccucguggucccccgguacgccuucgccaugaagcgcgggucgggcuccggcaucaucaucagcgacaccccggugcacgacugcaacaccacgugccagacccccaagggggccaucaacaccucccugcccuuccagaacauccaccccgugaccaucggcgagugcccgaaguacgucaagucgacgaagcugcggauggcgaccgggcuccgcaacauccccuccauccagagccggggccuguucggggccaucgccggcuucaucgagggcggguggaccggcaugaucgacgggugguacggcuaccaccaccagaacgagcagggguccggcuacgccgccgaccgcaagucgacccagaacgcgaucgacggcaucacgaacaaggugaacuccgugaucgagaagaugaacacccaguucaccgccgucgggaaggaguucaaccaccuggagaagcggaucgagaaccucaacaagaagguggacgacggcuuccuggacgucuggaccuacaacgccgagcugcucgugcugcuggagaacgagcgcacgcucgacuaccacgacagcaacgugaagaaccuguacgagaagguccggucccagcugaagaacaacgccaaggagaucgggaacggcugcuucgaguucuaccacaagugcgacgacacgugcauggagucggugaagaacgggaccuacgacuaccccaaguacuccgaggagagcaagcucaaccgcgaggagaucgacggcgugaagcuggaguccacccggaucuaccagauccuggccaucuacucgaccgucgcguccagccucgugcugcuggugucccucggcgccaucucguucuggaugugcagcaacgggucccugcagugccgcaucugcaucuga

SEQ ID NO: 134 - RNA, 1701 nt, Artificial Sequence
  derived and/or modified CDS sequence (AUadapt) from InfluenzaA__EPI291885__HA
augaaggccaucaucgugguccugcuccacaccuucgccaccgcggacgccgacacccugugcaucggcuaccacgccaacaacucgaccgacaccguggacaccgugcuggagaagaacgucacggugacccacuccgugaaccuccuggagaccaagcacgacgggaagcugugcaaccucaagggcgucgcgccccugcaccuggggaagugcaacaucgccggcuggcuccuggggaacccggagugcgagucgcuguucaccgccuccagcugguccuacaucguggagacgcccaacucggacaacgggaccugcuaccccggcaacuucaucaacuacgaggagcuccgcgagcaccuguccucgguguccagcuucgagcgguucgagaucuuccccaaggccaacuccuggccgaaccacgacaccaacaagggggucaccgccgccugccccuacgcgggcgccaacucguucuaccgcaaccugaucuggcucgugaagaaggggaacuccuaccccaagcugagcaaguccuacaucaacaacaagaagaaggaggugcuggucaucuggggcauccaccacccgcccacgucgaccgaccagcagacccucuaccagaacgccgacgccuacguguucgugggguccucgaaguacuccaagcgguucgagcccgagaucgccgcgcgccccaagguccggaaccaggccggccgcaugaacuacuacuggacccugaucgagcccggcgacacgaucaccuucgaggccaccgggaaccugguggugccgcgguacgccuucgccaugcgccggggcagcgggucgggcaucaucgucuccgacgcgcccgugcacgacugcaacaccacgugccagacccccaagggcgccaucaacaccagccuccccuuccagaacauccacccggugaccaucggggagugccccaaguacgucaaguccacgaagcugcgcauggccaccggccugcggaacauccccucgauccagucccgcggccucuucggcgccaucgccggguuccuggagggcggcuggaccgggaugaucgacggcugguacggguaccaccaccagaacgagcagggcucgggguacgcggccgaccagaaguccacccagaacgccaucgacggcaucacgaacaaggugaacagcaucaucgagaagaugaacacccaguucaccgccgugggcaaggaguucucccagcuggagaagcggaucgagucgcucaacaacaaggucgacgacggguuccuggacaucuggaccuacaacgccgagaugcuggugcuccuggagaacgagcgcacgcuggacuaccacgacuccaacgucaagaaccucuacgagaaggugcggagccagcugaagaacaacgcgaaggagaucggcaacgggugcuucgaguucuaccacaagugcgacaacacgugcauggaguccgugaagaacggcaccuacgacuaccccaaguacucggaggaggccaagcugaaccgcgaggagaucgacggggucaagcucgaguccgcccggaucuaccagauccuggccaucuacucgaccguggcguccagccuggugcuccuggucucccugggcgccgugucguucuggaugugcagcaacggcucccuccagugccgcaucugcaucuga

SEQ ID NO: 135 - RNA, 1701 nt, Artificial Sequence; identical to SEQ ID NO: 62
  derived and/or modified CDS sequence (AUadapt) from InfluenzaA__EPI176515__HA

SEQ ID NO: 136 - RNA, 1701 nt, Artificial Sequence; identical to SEQ ID NO: 117
  derived and/or modified CDS sequence (AUadapt) from InfluenzaA__EPI189182__HA

SEQ ID NO: 137 - RNA, 1701 nt, Artificial Sequence
  derived and/or modified CDS sequence (AUadapt) from InfluenzaA__EPI180574__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 138 - RNA, 1701 nt, Artificial Sequence
  derived and/or modified CDS sequence (AUadapt) from InfluenzaA__EPI377499__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacuggaacggggugacgcagaacggcaccagcuccgccugcauccggcgcucgaacaacuccuucuucagccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagccguccgggcgcaucaccgugucgaccaagcggucccagcaggccgugauccccaacaucggcagccgcccccggauccgcaacauccccucgcggaucuccaucuacuggaccaucgucaagccgggcgacauccugcucaucaacagcacggggaaccugaucgcgccccgcggcuacuucaagauccgguccggcaagucguccaucaugcgcagcgacgcccccaucgggaagugcaaguccgagugcaucacccccaacggcucgaucccgaacgacaagcccuuccagaacgugaaccggaucaccuacggggccugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucucggagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 139 - RNA, 1701 nt, Artificial Sequence
  derived and/or modified CDS sequence (AUadapt) from InfluenzaA__EPI346916__HA
augaaggccauccuggugguccuccuguacaccuucaccacggccaccgcggacacccugugcaucggcuaccacgccaacaacucgaccgacacgguggacaccgugcucgagaagaacgucaccgugacccacuccgugaaccugcuggagaaccgccacaacgggaagcucugcaagcugcggggcgucgcgccccugcaccucgggaagugcaacaucgccggcuggcugcuggggaacccggagugcgagagccucuccacggccucguccuggagcuacaucguggagaccuccaacucggacaacgggaccugcuaccccggcgacuucaucaacuacgaggagcugcgcgagcagcuguccagcguguccucguucgagcgguucgagaucuuccccaagaccuccagcuggcccaaccacgacacgaaccgcggcgucaccgccgccugcccgcacgacggcaccaacuccuucuaccggaaccucaucuggcuggugaagaaggggaacucguaccccaagaucaacaaguccuacaucaacaacaaggagaaggagauccuggugcucugggccauccaccaccccagcaccuccgccgaccagcagucgcuguaccagaacgcggacgccuacgucuucgugggcagcucccgcuacucgcggaaguucgagcccgagguggccacgcgcccgaagguccgggaccaggccgggcgcaugaacuacuacuggacccugguggagcccggcgacaagaucaccuucgaggccaccggcaaccucguggucccccgguacgcguucgcccugaagcgcaacuccgggagcggcaucaucaucuccgacacgucggugcacgacugcgacaccaacugccagacccccaacggggccaucaacaccucccugccguuccagaacauccaccccgugacgaucggcgagugccccaaguacgucaagagcaccaagcuccggauggccaccggccugcgcaacauccccuccauccagucgcgggggcuguucggcgccaucgcgggguucaucgagggcggguggaccggcaugaucgacggcugguacggguaccaccaccagaacgagcagggcuccggguacgccgccgaccucaagagcacgcagaacgccaucgacggcaucaccaacaaggugaacuccgugaucgagaagaugaacacccaguucaccgccgucgggaaggaguucucgcaccuggagcgccggaucgagaaccugaacaagaagguggacgacggcuuccucgacaucuggacguacaacgcggagcugcugguccuccuggagaacgagcgcacccuggacuaccacgacuccaacgugaagaaccucuacgagaaggugcggagccagcugaagaacaacgccaaggagaucggcaacgggugcuucgaguucuaccacaagugcgacgacaugugcauggaguccgucaagaacggcaccuacgacuacccgaaguacucggaggaggccaagcugaaccgcgaggagaucgacggggugaagcucgaguccacccggaucuaccagauccuggccaucuacagcacgguggccucgucccugguccucguggugagccugggcgcgaucuccuucuggaugugcagcaacgggucccugcagugccgcaucugcaucuga

SEQ ID NO: 140 - RNA, 1689 nt, Artificial Sequence
  derived and/or modified CDS sequence (AUadapt) from InfluenzaA__ACV49600  __HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucagcggcaaccccuccuucuuccgcaacaugguguggcugacggagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccgagaucgccacgcggcccaaggugaacggccagggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucgagaacugcgagaccaagugccagaccccgcugggcgccaucaacacgacccugcccuuccacaacgugcacccccucaccaucggggagugccccaaguacgucaagucggagaagcuggugcuggcgaccggccuccgcaacgugccgcagaucgagucccgggggcuguucggcgccaucgccggguucaucgagggcggcuggcaggggauggucgacggcugguacggguaccaccacucgaacgaccagggcuccggguacgccgccgacaaggagucgacgcagaaggcguucgacggcaucaccaacaaggugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacucggugaagaacggcaccuacgacuaccccaaguacgaggaggaguccaagcugaaccggaacgagaucaagggcgugaagcugucguccaugggggucuaccagauccucgccaucuacgccaccguggcgggcucgcugucccuggccaucaugauggccgggaucucguucuggaugugcuccaacggcagccuccagugccgcaucugcaucuga

SEQ ID NO: 141 - RNA, 1701 nt, Artificial Sequence
  derived and/or modified CDS sequence (AUadapt) from InfluenzaA__BAF48361__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucgagucgcgccccugggugcggggccuguccagccgcaucuccaucuacuggaccaucgucaagcccggcgacgugcucgugaucaacucgaacgggaaccugaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucucggagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagucgggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 142 - RNA, 1701 nt, Artificial Sequence
  derived and/or modified CDS sequence (AUadapt) from InfluenzaA__EPI507594__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccagcggcacccuggaguucaacaacgaguccuucaacugggccggggugacgcagaacggcaccucguccgccugcaagcgggggagcaacuccagcuucuucucccgccugaacuggcucacccaccugaacuucaaguaccccgcgcugaacgugaccaugcccaacaacgagcaguucgacaagcucuacaucuggggcguccaccaccccgugacggacaaggaccagaucuuccuguacgcccagucguccgggcggaucaccgugagcaccaagcgcagccagcaggccgucaucccgaacaucggcuuccggccccgcauccggaacauccccucccgcaucucgaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaagucggagugcaucacccccaacggcuccauccccaacgacaagccguuccagaacgugaaccgcaucaccuacggggcgugcccccgguacgucaagcagagcacccugaagcucgccacgggcaugcgcaacgugcccgagaagcagacccgggggaucuucggcgccaucgccggguucaucgagaacggcugggagggcaugguggacgggugguacggcuuccgccaccagaacuucgaggggcggggccaggccgcggaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 143 - RNA, 1701 nt, Artificial Sequence
  derived and/or modified CDS sequence (AUadapt) from InfluenzaA__EPI461953__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccucgggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacuucgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 144 - RNA, 1701 nt, Artificial Sequence
  derived and/or modified CDS sequence (AUadapt) from InfluenzaA__EPI461953__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccucgggcacccuggaguucaacaacgaguccuucaacugggccggggugacgcagaacggcaccagcuccgccugcaagcgggggucgaacuccagcuucuucucccgccugaacuggcucacccaccugaacuucaaguaccccgcgcugaacgugaccaugcccaacaacgagcaguucgacaagcucuacaucuggggcguccaccaccccgugacggacaaggaccagaucuuccuguacgcccagagcuccgggcggaucaccgugucgaccaagcgcagccagcaggccgucaucccgaacaucggcuaccggccccgcauccggaacauccccucccgcaucagcaucuacuggaccaucgugaagcccggcgacauccugcucaucaacuccacggggaaccugaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucaccuacggggcgugcccccgguacgucaagcagagcacccugaagcucgccacgggcaugcgcaacgugcccgagaagcagacccgggggaucuucggcgccaucgccggguucaucgagaacggcugggagggcaugguggacgggugguacggcuuccgccaccagaacuucgaggggcggggccaggccgcggaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 145 - RNA, 1701 nt, Artificial Sequence
  derived and/or modified CDS sequence (AUadapt) from InfluenzaA__EPI668105__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccgggggucguccagcuccuucuucucgcgccugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcggccggaucaccgugucgaccaagcgcucccagcaggccgugauccccaacaucggcagccggccccgcauccgggggauccccucccgcaucucgaucuacuggacgaucgucaagccgggcgacauccuccugaucaacuccaccgggaaccugaucgcgccccggggcuacuucaagauccgcagcggcaaguccucgaucaugcgguccgacgcccccaucgggaagugcaagagcgagugcaucacccccaacggcuccaucccgaacgacaagcccuuccagaacgugaaccgcaucaccuacggggccugcccccgguacgugaagcacucgacgcucaagcuggccaccggcaugcgcaacguccccgagaagcagacccgggggaucuucggcgccaucgccggcuucaucgagaacgggugggagggcaugguggacgggugguacggcuuccgccaccagaacuccgaggggcggggccaggccgccgaccucaagagcacccaggcggccaucgaccagaucaacggcaagcugaaccgccugaucgggaagacgaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggcgucgagcugaaguccggguacaaggacuggauccucuggaucucguucgccaucagcugcuuccugcugugcguggcccuccugggcuucaucaugugggccugccagaaggggaacauccggugcaacaucugcaucuga

SEQ ID NO: 146 - RNA, 1701 nt, Artificial Sequence
  derived and/or modified CDS sequence (AUadapt) from InfluenzaA__EPI578446__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccagcgggcgcaucaccgugucgaccaagcggucccagcaggccgugauccccaacaucggcagccgcccccggauccgcggcauccccucccggaucucgaucuacuggacgaucgucaagccgggggacauccuccugaucaacuccaccggcaaccugaucgcgccccgcggguacuucaagauccggagcggcaaguccucgaucaugcgcuccgacgcccccaucggcaagugcaagagcgagugcaucacccccaacggguccaucccgaacgacaagcccuuccagaacgugaaccggaucaccuacggcgccugcccccgcuacgugaagcacucgacgcucaagcuggccaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccuggagaaguacgucgaggacaccaagaucgaccucuggucguacaacgccgagcugcugguggcccucgagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcugaaguccggcuacaaggacuggauccucuggaucucguucgccaucagcugcuuccugcugugcguggcccuccugggguucaucaugugggccugccagaagggcaacauccgcugcaacaucugcaucuga

SEQ ID NO: 147 - RNA, 1701 nt, Artificial Sequence; identical to SEQ ID NO: 68
  derived and/or modified CDS sequence (AUadapt) from InfluenzaA__EPI551882__HA

SEQ ID NO: 148 - RNA, 1701 nt, Artificial Sequence
  derived and/or modified CDS sequence (AUadapt) from InfluenzaA__EPI344389__HA
augaagaccaucaucgccuucucgugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacucgccccaccagauccucgacggcaagaacugcacccugaucgacgcccugcucggggacccccacugcgacgaccugcagaacaaggagugggaccuguucgucgagcgguccaccgccuacagcaacugcuaccccuacuacgugccggacuacgcgacgcuccgcucccugguggccagcuccggcaaccuggaguucacccaggagucguucaacuggaccggcgucgcccaggacggguccagcuacgccugccggcgcggcuccgugaacagcuucuucucccggcucaacuggcuguacaaccugaacuacaaguaccccgagcagaacgugaccaugcccaacaacgacaaguucgacaagcucuacaucuggggcguccaccaccccgggacggacaaggaccagaccaaccuguacgugcaggcgucggggcgcgugaucgucuccaccaagcggagccagcagaccgugaucccgaacaucggcagccgccccugggugcggggcgucuccucgaucaucuccaucuacuggacgaucgugaagcccggggacauccugcucaucaacagcaccggcaaccugaucgcgccccgcggguacuucaagauccaguccggcaagagcuccaucaugcggucggacgcccacaucgacgagugcaacuccgagugcaucaccccgaacggcagcauccccaacgacaagcccuuccagaacgugaacaagaucaccuacggggccugcccccgcuacgucaagcagaacacgcugaagcucgccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccucgagaaguacguggaggacaccaagaucgaccuguggucguacaacgccgagcugcucgucgcccuggagaaccagcacacgaucgaccugaccgacuccgagaugagcaagcuguucgagcgcacccggcgccagcugcgggagaacgccgaggacaugggcaacgggugcuucaagaucuaccacaagugcgacaacgccugcaucggcuccauccgcaacgggaccuacgaccacgacaucuaccgcaacgaggcgcugaacaaccgguuccagaucaagggcgugcagcucaagagcggguacaaggacuggauccuguggaucuccuucgccaucagcugcuuccugcucugcgucgugcugcugggcuucaucaugugggccugccagaagggcaacauccgcugcaacaucugcaucuga

SEQ ID NO: 149 - RNA, 1701 nt, Artificial Sequence
  derived and/or modified CDS sequence (AUadapt) from InfluenzaA__EPI348782__HA
augaagaccaucaucgccuucucgugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacucgccccaccagauccucgacggcaagaacugcacccugaucgacgcccugcucggggacccccacugcgacgaccugcagaacaaggagugggaccuguucgucgagcgguccaccgccuacagcaacugcuaccccuacuacgugccggacuacgcgacgcuccgcucccugguggccagcuccggcaaccuggaguucacccaggagucguucaacuggaccggcgucgcccaggacggguccagcuacgccugccggcgcggcuccgugaacagcuucuucucccggcucaacuggcuguacaagcugaacuacaaguaccccgagcagaacgugaccaugcccaacaacgacaaguucgacaagcucuacaucuggggcguccaccaccccgggacggacaaggaccagaccaacaucuacgugcaggcgucggggcgcgugaucgucuccaccaagcggagccagcagaccgugaucccgaacaucggcagccgccccugggugcggggcgucuccucgaucaucuccaucuacuggacgaucgugaagcccggggacauccugcugaucaacagcaccggcaaccucaucgcgccccgcggguacuucaagauccaguccggcaagagcuccaucaugcggucggacgcccacaucgacgagugcaacuccgagugcaucaccccgaacggcagcauccccaacgacaagcccuuccagaacgugaacaagaucaccuacggggccugcccccgcuacgucaagcagaacacgcugaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccuggagaaguacguggaggacaccaagaucgaccucuggucguacaacgccgagcugcuggucgcccucgagaaccagcacacgaucgaccugaccgacuccgagaugagcaagcuguucgagcgcacccggcgccagcuccgggagaacgccgaggacaugggcaacgggugcuucaagaucuaccacaagugcgacaacgccugcaucggcuccauccgcaacgggaccuacgaccacgacaucuaccgcaacgaggcgcugaacaaccgguuccagaucaagggcgugcagcucaagagcggguacaaggacuggauccuguggaucuccuucgccaucagcugcuuccugcugugcgucgugcuccugggcuucaucaugugggccugccagaagggcaacauccgcugcaacaucugcaucuga

SEQ ID NO: 150 - RNA, 1701 nt, Artificial Sequence
  derived and/or modified CDS sequence (AUadapt) from InfluenzaA__EPI642513__HA
augaagaccaucaucgccuucucgugcauccugugccucaucuucgcccagaagcugcccggcuccgacaagagcauggcgacccugugccucgggcaccacgccgugccgaacggcacgcuggucaagaccaucaccgacgaccagaucgaggugaccaacgccacggagcuggugcaguccagcuccaccucgcgcaucugcaacagcccccaccagauccucgacgggaagaacugcacccugaucgacgcccugcucggcgacccccacugcgacgacuuccagaacaagaagugggaccuguucgucgagcgguccaccgccuacuccaacugcuaccccuacuacgugccggacuacgcgacgcugcgcagccucaucgccuccagcgggaaccuggaguucacccaggaguccuucaacuggaccggcguggcccaggacggcucguccuacgccugccggcgcgggagcgucaacuccuucuucagccggcugaacuggcucuacaaccugaacuacaaguaccccgagcagaacgugaccaugcccaacaacgacaaguucgacaagcuguacaucuggggcgugcaccaccccgggacggacaaggaccagaccaaccucuacguccaggcguccggccgcgugaucgugagcaccaagcggucgcagcagaccgucaucccgaacaucgggucccgccccugggugcggggcgugagcuccaucaucagcaucuacuggacgaucgucaagcccggcgacauccugcugaucaacuccaccgggaaccucaucgcgccccgcggcuacuucaagauccagagcgggaaguccucgaucaugcgguccgacgcccacaucgacgagugcaacagcgagugcaucaccccgaacggcuccauccccaacgacaagcccuuccagaacgugaacaagaucaccuacggcgccugcccccgcuacgugaagcagaacacgcugaagcuggccaccgggaugcggaacgucccggagaagcagacccgcggcaucuucggggccaucgccggcuucaucgagaacgggugggagggcaugguggacggcugguacggguuccggcaccagaacagcgagggcaccgggcaggccgccgaccucaaguccacgcaggccgcgaucaaccagaucaccggcaagcugaaccgcgugaucaagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacucggagauguccaagcuguucgagcgcacccggcgccagcuccgggagaacgccgaggacaugggcaacggcugcuucaagaucuaccacaagugcgacaacgccugcaucgggagcauccgcaacggcaccuacgaccacgacaucuaccgcaacgaggcgcugaacaaccgguuccagaucaaggggguccagcugaaguccggcuacaaggacuggauccucuggaucagcuucgccaucagcugcuuccugcugugcgugguccuccugggguucaucaugugggccugccagaagggcaacauccgcugcaacaucugcaucuga

SEQ ID NO: 151 - RNA, 1701 nt, Artificial Sequence
  derived and/or modified CDS sequence (AUadapt) from InfluenzaA__EPI293965__HA
augaagaccaucaucgccuucucgugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacucgccccaccagauccucgacggcaagaacugcacccugaucgacgcccugcucggggacccccacugcgacgacuuccagaacaaggagugggaccuguucgucgagcgguccaccgccuacagcaacugcuaccccuacuacgugccggacuacgcgacgcugcgcucccucguggccagcuccggcaaccuggaguucacccaggagagcuucaacuggaccggcgucgcccaggacggguccucguacgccugccggcgcggcuccgugaacagcuucuucucccggcugaacuggcucuacaaccugaacuacaaguaccccgagcagaacgugaccaugcccaacaacgacaaguucgacaagcuguacaucuggggcguccaccaccccgggacggacaaggaccagaccaaccucuacgugcaggcgagcgggcgcgugaucgucuccaccaagcggagccagcagaccgugaucccgaacaucggcucgcgccccugggugcggggcgucuccagcaucaucuccaucuacuggacgaucgugaagcccggggacauccugcugaucaacagcaccggcaaccucaucgcgccccgcggguacuucaagauccaguccggcaagucguccaucaugcggagcgacgcccacaucgacgagugcaacuccgagugcaucaccccgaacggcagcauccccaacgacaagcccuuccagaacgugaacaagaucaccuacggggccugcccccgcuacgucaagcagaacacgcugaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccuggagaaguacguggaggacaccaagaucgaccucuggucguacaacgccgagcugcuggucgcccucgagaaccagcacacgaucgaccugaccgacuccgagaugagcaagcuguucgagcgcacccggcgccagcuccgggagaacgccgaggacaugggcaacgggugcuucaagaucuaccacaagugcgacaacgccugcaucggcuccauccgcaacgggaccuacgaccacgacaucuaccgcaacgaggcgcugaacaaccgguuccagaucaagggcgugcagcucaagagcggguacaaggacuggauccuguggaucuccuucgccaucagcugcuuccugcugugcgucgugcuccugggcuucaucaugugggccugccagaagggcaacauccgcugcaacaucugcaucuga

SEQ ID NO: 152 - RNA, 1701 nt, Artificial Sequence
  derived and/or modified CDS sequence (AUadapt) from InfluenzaA__EPI465400__HA
augaagaccaucaucgccuucucgugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacucgccccaccagauccucgacggcaagaacugcacccugaucgacgcccugcucggggacccccacugcgacgacuuccagaacaaggagugggaccuguucgucgagcgguccaccgccuacagcaacugcuaccccuacuacgugccggacuacgcgacgcugcgcucccucguggccagcuccggcaaccuggaguucacccaggagagcuucaacuggaccggcgucgcccaggacggguccucguacgccugccggcgcggcuccgugaacagcuucuucucccggcugaacuggcucuacaaccugaacuacaaguaccccgagcagaacgugaccaugcccaacaacgacaaguucgacaagcuguacaucuggggcguccaccaccccgggacggacaaggaccagaccaagcucuacgugcaggcgagcgggcgcgugaucgucuccaccaagcggagccagcagaccgugaucccgaacaucggcucgcgccccugggugcggggcgucuccagcaucaucuccaucuacuggacgaucgugaagcccggggacauccugcugaucaacagcaccggcaaccucaucgcgccccgcggguacuucaagauccaguccggcaagucguccaucaugcggagcgacgcccacaucgacgagugcaacuccgagugcaucaccccgaacggcagcauccccaacgacaagcccuuccagaacgugaacaagaucaccuacggggccugcccccgcuacgucaagcagaacacgcugaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccuggagaaguacguggaggacaccaagaucgaccucuggucguacaacgccgagcugcuggucgcccucgagaaccagcacacgaucgaccugaccgacuccgagaugagcaagcuguucgagcgcacccggcgccagcuccgggagaacgccgaggacaugggcaacgggugcuucaagaucuaccacaagugcgacaacgccugcaucggcuccauccgcaacgggaccuacgaccacgacaucuaccgcaacgaggcgcugaacaaccgguuccagaucaagggcgugcagcucaagagcggguacaaggacuggauccuguggaucuccuucgccaucagcugcuuccugcugugcgucgugcuccugggcuucaucaugugggccugccagaagggcaacauccgcugcaacaucugcaucuga

SEQ ID NO: 153 - RNA, 1701 nt, Artificial Sequence
  derived and/or modified CDS sequence (AUadapt) from InfluenzaA__EPI328898__HA
augaagaccaucaucgccuucucgugcauccugugccucaucuucgcccagaagcugcccggcuccgacaacagcauggcgacccugugccucgggcaccacgccgugccgaacggcacgcuggucaagaccaucaccgacgaccagaucgaggugaccaacgccacggagcuggugcaguccagcuccaccgggcgcaucugcaacucgccccaccagauccucgacggcaagaacugcacccugaucgacgcccugcucggggacccccacugcgacgacuuccagaacaaggagugggaccuguucgucgagcgguccaccgccuacagcaacugcuaccccuacuacgugccggacuacgcgacgcugcgcucccucguggccagcuccggcaaccuggaguucacccaggagagcuucaacuggaccggcgucgcccaggacggguccucguacgccugccggcgcggcuccgugaacagcuucuucucccggcugaacuggcucuacaaccugaacuacaaguaccccgagcagaacgugaccaugcccaacaacgacaaguucgacaagcuguacaucuggggcguccaccaccccgggacggacaaggaccagaccaagaucuacgugcaggcgagcgggcgcgugaucgucuccaccaagcggagccagcagaccgugaucccgaacaucggcucgcgccccugggugcggggcgucuccagcaucaucuccaucuacuggacgaucgugaagcccggggacauccuccugaucaacagcaccggcaaccugaucgcgccccgcggguacuucaagauccaguccggcaagucguccaucaugcggagcgacgcccacaucgacgagugcaacuccgagugcaucaccccgaacggcagcauccccaacgacaagcccuuccagaacgugaacaagaucaccuacggggccugcccccgcuacgucaagcagaacacgcucaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgccgaccucaagagcacgcaggccgcgaucaaccagaucaccgggaagcugaaccgcgucaucaagaagaccaacgagaaguuccaccagaucgagaaggaguucuccgagguggagggccggauccaggaccuggagaaguacguggaggacaccaagaucgaccuguggucguacaacgccgagcuccuggucgcccuggagaaccagcacacgaucgaccucaccgacuccgagaugagcaagcuguucgagcgcacccggcgccagcugcgggagaacgccgaggacaugggcaacgggugcuucaagaucuaccacaagugcgacaacgccugcaucggcuccauccgcaacgggaccuacgaccacgacaucuaccgcaacgaggcgcucaacaaccgguuccagaucaagggcgugcagcucaagagcggguacaaggacuggauccuguggaucuccuucgccaucagcugcuuccugcugugcgucgugcugcucggcuucaucaugugggccugccagaagggcaacauccgcugcaacaucugcaucuga

SEQ ID NO: 154 - RNA, 1701 nt, Artificial Sequence; identical to SEQ ID NO: 153
  derived and/or modified CDS sequence (AUadapt) from InfluenzaA__EPI328900__HA

SEQ ID NO: 155 - RNA, 1701 nt, Artificial Sequence
  derived and/or modified CDS sequence (AUadapt) from InfluenzaA__EPI574644__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcaagaacugcacccugaucgacgcccugcucggggacccccagugcgacggcuuccagaacaagcggugggaccuguucguggagcgcuccaaggccuacucgaacugcuaccccuacgacgugccggacuacgcgucccugcggagccucgucgccuccucgggcacccuggaguucaacgacgaguccuucaacugggccggggugacgcagaacggcaccagcuccgccugcauccgcgggucgaacuccagcuucuucucccggcugaacuggcucacccacucgaacuucaaguaccccgcgcugaacgugaccaugcccaacaacgagcaguucgacaagcuguacaucuggggcguccaccaccccgggacggacaaggaccagaucuuccucuacgcccacuccagcggccgcaucaccgugucgaccaagcggucccagcaggccgugaucccgaacaucggcagccgcccccggauccgcaacauccccucccggaucucgaucuacuggaccaucgucaagcccggggacauccugcugaucaacuccacgggcaaccucaucgccccgcgcggguacuucaagauccagagcggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcagucgacccugaagcuggccacggggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggucguacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcguggagcucaaguccggcuacaaggacuggauccuguggaucucguucgccaucagcugcuuccugcucugcgucgcccugcugggguucaucaugugggcgugccagaagggcaacauccggugcaacaucugcaucuga

SEQ ID NO: 156 - RNA, 1701 nt, Artificial Sequence
  derived and/or modified CDS sequence (AUadapt) from InfluenzaA__EPI563212__HA
augaagaccaucaucgcccugucguacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccucgaucggggagaucugcgacagcccccaccagauccuggacggcgagaacugcacccucaucgacgcccugcugggggacccccagugcgacggcuuccagaacaagaagugggaccucuucguggagcggucgaaggccuacuccaacugcuaccccuacgacgugccggacuacgcgagccugcgcucccuggucgccucguccggcacccucgaguucaacaacgagagcuucaacuggacgggggugacccagaacggcaccuccucggccugcauccggcgcuccagcuccucguucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcuccgggcgcaucaccgugucgaccaagcggucgcagcaggccgugauccccaacaucggcucccgcccccggauccgcggcauccccagccggaucuccaucuacuggacgaucgucaagccgggggacauccuccugaucaacucgaccggcaaccugaucgcgccccgcggguacuucaagauccgguccggcaagagcuccaucaugcgcucggacgcccccaucggcaagugcaaguccgagugcaucacccccaacgggagcaucccgaacgacaagcccuuccagaacgugaaccggaucaccuacggcgccugcccccgcuacgugaagcacuccacgcucaagcuggccaccgggaugcggaacguccccgagaagcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcucaaccggcugaucggcaagacgaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacaccaucgaccugaccgacucggagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcugaaguccggcuacaaggacuggauccucuggaucuccuucgccaucagcugcuuccugcugugcguggcccuccugggguucaucaugugggccugccagaagggcaacauccgcugcaacaucugcaucuga

SEQ ID NO: 157 - RNA, 1701 nt, Artificial Sequence; identical to SEQ ID NO: 156
  derived and/or modified CDS sequence (AUadapt) from InfluenzaA__EPI553999__HA

SEQ ID NO: 158 - RNA, 1701 nt, Artificial Sequence
  derived and/or modified CDS sequence (AUadapt) from InfluenzaA__EPI551570__HA
augaagaccaucaucgcccugucguacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccagcaucggggagaucugcgacucgccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgucgcugcgcucccuggucgccagcuccggcacccucgaguucaacaacgagucguucaacuggacgggggugacccagaacggcaccuccagcgccugcauccggcgcuccucguccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagucguccgggcgcaucaccgugagcacgaagcggucgcagcaggccgugaucccgaacaucggcucccgcccccggauccgcgacauccccagccggaucuccaucuacuggaccaucgucaagcccggcgacauccugcugaucaacucgaccgggaaccucaucgccccgcgcggcuacuucaagauccgguccgggaaguccuccaucaugcgcagcgacgcccccaucggcaagugcaaguccgagugcaucacccccaacggcucgauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 159 - RNA, 1701 nt, Artificial Sequence
  derived and/or modified CDS sequence (AUadapt) from InfluenzaA__EPI629738__HA
augaagaccaucaucgcccugucguacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccagcaucggggagaucugcgacucgccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgucgcugcgcucccuggucgccagcuccggcacccucgaguucaacaacgagucguucaacuggacgggggugacccagaacggcaccuccagcgccugcauccggcgcuccucguccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagucguccgggcgcaucaucgugagcaccaagcggucgcagcaggccgugauccccaacaucggcucccgcccccggauccgcgacauccccagccggaucuccaucuacuggaccaucgucaagccgggcgacauccuccugaucaacucgacggggaaccugaucgcgccccgcggcuacuucaagauccgguccgggaaguccuccaucaugcgcagcgacgcccccaucggcaagugcaaguccgagugcaucacccccaacggcucgaucccgaacgacaagcccuuccagaacgugaaccggaucaccuacggggccugcccccgcuacgugaagcacuccacccucaagcuggccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcucaaccggcugaucggcaagaccaacgagaaguuccaccagaucgagaaggaguucucggagguggagggccgcauccaggaccuggagaaguacgucgaggacacgaagaucgaccucugguccuacaacgccgagcugcugguggcccucgagaaccagcacaccaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcacguacgaccacaacguguaccgcgacgaggcccugaacaaccgguuccagaucaagggggucgagcucaagucgggcuacaaggacuggauccuguggaucuccuucgccaucagcugcuuccugcugugcguggcccuccugggcuucaucaugugggccugccagaaggggaacauccgcugcaacaucugcaucuga

SEQ ID NO: 160 - RNA, 1701 nt, Artificial Sequence
  derived and/or modified CDS sequence (AUadapt) from InfluenzaA__EPI631887__HA
augaagaccaucaucgcccugucguacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccucgaucggggagaucugcgacagcccccaccagauccuggacggcgagaacugcacccucaucgacgcccugcugggggacccccagugcgacggcuuccagaacaagaagugggaccucuucguggagcggucgaaggccuacuccaacugcuaccccuacgacgugccggacuacgcgagccugcgcucccuggucgccucguccggcacccucgaguucaacaacgagagcuucaacuggacgggggugacccagaacggcaccuccucggccugcauccggcgcuccagcuccucguucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcuccgggcgcaucaucgugucgaccaagcggagccagcaggccgugauccccaacaucggcucccgcccccggauccgcgacucgcccucccggaucagcaucuacuggaccaucgucaagccgggcgacauccuccugaucaacuccacggggaaccugaucgcgccccgcggcuacuucaagauccggucggggaaguccagcaucaugcgcuccgacgcccccaucggcaagugcaagucggagugcaucacccccaacggcuccaucccgaacgacaagcccuuccagaacgugaaccggaucaccuacggggccugcccccgcuacgugaagcacagcacccucaagcuggccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacccaggcggccaucgaccagaucaacgggaagcucaaccggcugaucggcaagaccaacgagaaguuccaccagaucgagaaggaguucuccgagguggagggccgcauccaggaccuggagaaguacgucgaggacacgaagaucgaccucuggucguacaacgccgagcugcugguggcccucgagaaccagcacaccaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcacguacgaccacaacguguaccgcgacgaggcccugaacaaccgguuccagaucaagggggucgagcugaaguccggcuacaaggacuggauccucuggaucucguucgccaucagcugcuuccugcugugcguggcccuccugggcuucaucaugugggccugccagaaggggaacauccgcugcaacaucugcaucuga

SEQ ID NO: 161 - RNA, 1701 nt, Artificial Sequence
  derived and/or modified CDS sequence (AUadapt) from InfluenzaA__EPI577026__HA
augaagaccaucaucgcccugucguacauccucugccugguguucgcccagaagauccccggcaacgacaacaacaccgcgacgcugugccucgggcaccacgccgucccgaacggcaccaucgugaagaccaucaccaacgaccgcaucgaggugacgaacgccaccgagcugguccagaacuccucgaucggggagaucugcgacagcccccaccagauccuggacggcgagaacugcacccucaucgacgcccugcugggggacccccagugcgacggcuuccagaacaagaagugggaccucuucguggagcggucgaaggccuacuccaacugcuaccccuacgacgugccggacuacgcgagccugcgcucccuggucgccucguccggcacccucgaguucaacaacgagagcuucaacuggacgggggugacccagaacggcaccuccucggccugcauccggcgcuccagcuccucguucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagagcuccgggcgcaucaccgugucgaccaagcggucgcagcaggccgugauccccaacaucggcucccgcccccggauccgcggcauccccagccggaucuccaucuacuggacgaucgucaagccgggggacauccuccugaucaacucgaccggcaaccugaucgcgccccgcggguacuucaagauccgguccggcaagagcuccaucaugcgcucggacgcccccaucggcaagugcaaguccgagugcaucacccccaacgggagcaucccgaacgacaagcccuuccagaacgugaaccggaucaccuacggcgccugcccccgcuacgugaagcacuccacgcucaagcuggccaccgggaugcggaacguccccgagaagcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcucaaccggcugaucggcaagacgaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacaccaucgaccugaccgacucggagaugaacaagcuguucgagaagacgaagaagcagcuccgcgagaacgccgaggacaugggcaacgggugcuucaagaucuaccacaagugcgacaacgcgugcaucgaguccauccggaacggcaccuacgaccacaacguguaccgcgacgaggcccugaacaaccgguuccagaucaagggggucgagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 162 - RNA, 1701 nt, Artificial Sequence
  derived and/or modified CDS sequence (AUadapt) from InfluenzaA__EPI404927__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 163 - RNA, 1701 nt, Artificial Sequence
  derived and/or modified CDS sequence (AUadapt) from InfluenzaA__EPI489319__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggggugacgcagaacggcaccagcuccgccugcaagcgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuucccguacgcccagucguccggccggaucaccgugagcaccaagcgcucgcagcaggccgugauccccaacaucggcucccggccccgcauccggaacauccccucgcgcaucuccaucuacuggaccaucgucaagccgggggacauccugcugaucaacagcacgggcaaccucaucgcgccccggggguacuucaagauccgcuccggcaagucguccaucaugcggagcgacgcccccaucggcaagugcaaguccgagugcaucacccccaacgggucgaucccgaacgacaagcccuuccagaacgugaaccgcaucaccuacggcgccugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucucggagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagucgggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 164 - RNA, 1701 nt, Artificial Sequence
  derived and/or modified CDS sequence (AUadapt) from InfluenzaA__EPI530647__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacucguccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagucgagcggccggaucaccguguccaccaagcgcucgcagcaggccgugaucccgaacaucggcucccggccccgcauccgggacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 165 - RNA, 1701 nt, Artificial Sequence; identical to SEQ ID NO: 68
  derived and/or modified CDS sequence (AUadapt) from InfluenzaA__EPI541083__HA

SEQ ID NO: 166 - RNA, 1701 nt, Artificial Sequence
  derived and/or modified CDS sequence (AUadapt) from InfluenzaA__EPI684315__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcaguccucggggcgcaucaucgugagcaccaagcggucccagcaggccgugauccccaacaucggcucgcgcccccggauccgcgacauccccucccggaucagcaucuacuggaccaucgucaagccgggcgacauccuccugaucaacuccacggggaaccugaucgcgccccgcggcuacuucaagauccggucggggaaguccagcaucaugcgcuccgacgcccccaucggcaagugcaagucggagugcaucacccccaacggcuccaucccgaacgacaagcccuuccagaacgugaaccggaucaccuacggggccugcccccgcuacgugaagcacagcacccucaagcuggccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccggaacggcacguacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 167 - RNA, 1701 nt, Artificial Sequence
  derived and/or modified CDS sequence (AUadapt) from InfluenzaA__EPI614462__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacucguccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagucgagcggccggaucaccguguccacccgccggucgcagcaggccgugaucccgaacaucggcucccgcccccggauccgcgacauccccagccggaucuccaucuacuggaccaucgucaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgccugcccccgcuacgugaagcaguccacccugaagcucgcgacggggaugcggaacguccccgagcgccagacccggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcucaagagcggcuacaaggacuggauccuguggaucagcuucgccaucuccugcuuccugcugugcguggcccugcucggguucaucaugugggccugccagaagggcaacauccggugcaacaucugcaucuga

SEQ ID NO: 168 - RNA, 1701 nt, Artificial Sequence
  derived and/or modified CDS sequence (AUadapt) from InfluenzaA__EPI541465__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggggugacgcagaacggcaccagcuccucgugcauccggggguccaacaacagcuucuucucccgccugaacuggcucacccaccugaacucgaaguaccccgcccugaacgugaccaugcccaacaacgagcaguucgacaagcucuacaucuggggcguccaccaccccgggacggacaaggaccagaucuuccuguacgcgcaguccagcggccggaucaccgugucgacccgccggucccagcaggccgugaucccgaacaucggcagccgcccccggauccgcgggauccccucccggaucucgaucuacuggaccaucgucaagcccggcgacauccugcucaucaacuccacggggaaccugaucgccccgcgcggcuacuucaagauccggagcggcaaguccucgaucaugcgcuccgacgcccccaucgggaagugcaagagcgagugcaucacccccaacggcuccauccccaacgacaagccguuccagaacgugaaccggaucaccuacggggccugcccccgcuacgugaagcagucgacccugaagcucgcgacgggcaugcggaacguccccgagcgccagacccgggggaucuucggcgccaucgccggcuucaucgagaacgggugggagggcaugguggacgggugguacggcuuccgccaccagaacuccgaggggcggggccaggccgccgaccucaagagcacccaggcggccaucgaccagaucaacggcaagcugaaccgccugaucgggaagaccaacgagaaguuccaccagaucgagaaggaguucuccgagguggagggccgcauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggcgucgagcugaaguccggguacaaggacuggauccuguggaucucguucgccaucagcugcuuccuccugugcguggcccugcucggcuucaucaugugggccugccagaaggggaacauccggugcaacaucugcaucuga

SEQ ID NO: 169 - RNA, 1701 nt, Artificial Sequence
  derived and/or modified CDS sequence (AUadapt) from InfluenzaA__EPI696967__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacucguccuucuucagccgccugaacuggcucacccggcugaacuccaaguaccccgcccugaacgugaccaugcccaacaacgagcaguucgacaagcucuacaucuggggcguccaccaccccgagacggacaaggaccagaucuuccuguacgcgcagucgagcgggcgcaucaccguguccacccggcgcucgcagcaggccgugaucccgaacaucggcucccggccccgcauccggggcauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 170 - RNA, 1701 nt, Artificial Sequence
  derived and/or modified CDS sequence (AUadapt) from InfluenzaA__EPI674597__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacaacucguucuucucccgccugaacuggcucacccaccugaacagcaaguaccccgcccugaacgugaccaugcccaacaacgagcaguucgacaagcucuacaucuggggcguccaccaccccgugacggacaaggaccagaucuuccuguacgcgcaguccucggggcggaucaccgugagcacccgccggucccagcaggccgucaucccgaacaucggcucgcgcccccggauccgcggcauccccucccggaucagcaucuacuggaccaucgugaagcccggggacauccugcucaucaacuccacgggcaaccugaucgccccgcgcggguacuucaagauccggucgggcaaguccagcaucaugcgcuccgacgcccccaucggcaagugcaagucggagugcaucacccccaacggguccauccccaacgacaagccguuccagaacgugaaccggaucaccuacggcgccugcccccgcuacgucaagcagagcacccugaagcucgcgacggggaugcggaacgugcccgagcgccagacccggggcaucuucggggccaucgccggcuucaucgagaacggcugggaggggaugguggacggcugguacggguuccgccaccagaacuccgagggccgggggcaggccgccgaccucaagucgacccaggcggccaucgaccagaucaacggcaagcugaaccgccugaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 171 - RNA, 1701 nt, Artificial Sequence
  derived and/or modified CDS sequence (AUadapt) from InfluenzaA__EPI530677__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacucguccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagucgagcggccggaucaccguguccaccaagcgcucgcagcaggccgugaucccgaacaucggcucccggccccgcauccgggacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagaagcagacccggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcucaagagcggcuacaaggacuggauccuguggaucagcuucgccaucuccugcuuccugcugugcguggcccugcucggguucaucaugugggccugccagaagggcaacauccggugcaacaucugcaucuga

SEQ ID NO: 172 - RNA, 1701 nt, Artificial Sequence
  derived and/or modified CDS sequence (AUadapt) from InfluenzaA__EPI530679__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacagcuccuucuucucgcgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccagcggccggaucaccgugucgaccaagcgcucccagcaggccgugaucccgaacaucggcagccggccccgcauccgggacauccccucccgcaucucgaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagucggagugcaucacccccaacggguccauccccaacgacaagccguuccagaacgugaaccgcaucaccuacggcgccugcccccgguacgugaagcagagcacccugaagcucgcgacggggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacccaggcggccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 173 - RNA, 1701 nt, Artificial Sequence
  derived and/or modified CDS sequence (AUadapt) from InfluenzaA__AAG01785__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucaucgagcgcagcaaggccuacuccaacugcuaccccuacgacgugccggacuacucgucccuccggagccugguggcguccagcggcacgcuggaguucaccaacgaggacuucaacuggaccggggucgcccaggacggcggguccuacucgugcaagcgcgaguccgugaaguccuucuucucccggcucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgcgugaccgucucgaccaaguccagccagcagacggugaucccgaacaucggcucccggcccugggugcgcggcaucagcucccggaucucgaucuacuggaccaucgucaagcccggggacauccuccugaucuccagcaccggcaaccugaucgcgccccgcggguacuucaagauccggaacggcaaguccagcaucaugcgcuccgacgccccgaucgacaacugcuacucggagugcaucacccccaacggcuccauccccaacgacaagcccuuccagaacgugaaccggaucacguacggggccugcccgaaguacgugaagcagaagacccucaagcuggccaccggcaugcgcaacguccccgagaagcagacccgggggaucuucggcgccaucgcgggguucaucgagaacggcugggagggcaugguggacgggugguacggcuuccgccaccagaacagcgaggggacgggccaggccgccgaccugaaguccacccaggccgccaucgaccaggugaacgggaagcucaaccggcugaucgagaagaccaacgagaaguuccaccagaucgagaaggaguucagcgaggucgagggccgcauccaggaccuggagaaguacguggaggacaccaagaucgaccucugguccuacaacgcggagcugcugguggcccucgagaaccagcacacgaucgaccugaccgacucggagaugaacaagcuguucgagaagacccggaagcagcuccgcgagaacgccgaggacaugggcaacgggugcuucaagaucuaccacaagugcgacaacgccugcaucggcuccauccggaacgggaccuacgaccacgacgucuaccgcgacgaggcccugaacaaccgcuuccagaucaagggcguggagcucaagagcggguacaaggacuggauccuguggaucagcuucgcgaucuccugcuuccugcugugcgucgugcuccugggcuucaucaugugggccugccagaagggcaacauccggugcaacaucugcaucuga

SEQ ID NO: 174 - RNA, 1701 nt, Artificial Sequence; identical to SEQ ID NO: 164
  derived and/or modified CDS sequence (AUadapt) from InfluenzaA__EPI814528__HA

SEQ ID NO: 175 - RNA, 1701 nt, Artificial Sequence
  derived and/or modified CDS sequence (AUadapt) from InfluenzaA__EPI674736__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugccggcgcggguccaacucguccuucuucagccggcugaacuggcucacccaccugaacuccaaguaccccgcccugaacgugaccaugcccaacaacgagcaguucgacaagcucuacaucuggggcguccaccaccccgugacggacaaggaccagaucuuccuguacgcgcagucgagcgggcgcaucaccguguccaccaagcggucgcagcaggccgucaucccgaacaucggcucccgcccccggauccgcgacauccccagccggaucuccaucuacuggaccaucgugaagcccggcgacauccugcucaucaacucgacggggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgucaagcaguccacccugaagcucgcgacgggcaugcggaacgugcccgagcgccagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaaggggguggagcucaagagcggcuacaaggacuggauccuguggaucagcuucgccaucuccugcuuccugcugugcguggcccugcucggcuucaucaugugggccugccagaaggggaacauccggugcaacaucugcaucuga

SEQ ID NO: 176 - RNA, 1701 nt, Artificial Sequence; identical to SEQ ID NO: 164
  derived and/or modified CDS sequence (AUadapt) from InfluenzaA__EPI614444__HA

SEQ ID NO: 177 - RNA, 1701 nt, Artificial Sequence
  derived and/or modified CDS sequence (AUadapt) from InfluenzaA__EPI551814__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugccggcgcggguccaacucguccuucuucagccggcugaacuggcucacccgccugaacuccaaguaccccgcccugaacgugaccaugcccaacaacgagcaguucgacaagcucuacaucuggggcguccaccaccccgugacggacaaggaccagaucuuccuguacgcgcagucgagcgggcggaucaccguguccaccaagcgcucgcagcaggccgucaucccgaacaucggcucccggccccgcauccgggacauccccagccgcaucuccaucuacuggaccaucgugaagcccggcgacauccugcucaucaacucgacggggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgucaagcaguccacccugaagcucgcgacgggcaugcgcaacgugcccgagcggcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgguuccagaucaaggggguggagcucaagagcggcuacaaggacuggauccuguggaucagcuucgccaucuccugcuuccugcugugcguggcccugcucggcuucaucaugugggccugccagaaggggaacauccgcugcaacaucugcaucuga

SEQ ID NO: 178 - RNA, 1701 nt, Artificial Sequence
  derived and/or modified CDS sequence (AUadapt) from InfluenzaA__EPI696955__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugccggcgcggguccaacucguccuucuucagccggcugaacuggcucacccaccugaacuccaaguaccccgcccugaacgugaccaugcccaacaacgagcaguucgacaagcucuacaucuggggcguccaccaccccgugacggacaaggaccagaucuuccuguacgcgcagucgagcgggcgcaucaccguguccaccaagcggucgcagcaggccgucaucccgaacaucggcuaccgcccccggauccgcgacauccccucccggaucagcaucuacuggaccaucgugaagcccggcgacauccugcucaucaacuccacggggaaccugaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgucaagcagagcacccugaagcucgcgacgggcaugcggaacgugcccgagcgccagacccgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcacguacgaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 179 - RNA, 1701 nt, Artificial Sequence
  derived and/or modified CDS sequence (AUadapt) from InfluenzaA__EPI740790__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugccggcgcggguccaacagcuccuucuucucgcggcugaacuggcucacccaccugaacuccaaguaccccgcccugaacgugaccaugcccaacaacgagcaguucgacaagcucuacaucuggggcguccaccaccccgugacggacaaggaccagaucuuccuguacgcgcagagcucggggcgcaucaccguguccaccaagcggagccagcaggccgucaucccgaacaucggcuuccgcccccggauccgcgacauccccucccggaucucgaucuacuggaccaucgugaagcccggcgacauccugcucaucaacuccacggggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacgucaagcagagcacccugaagcucgcgacgggcaugcggaacgugcccgagcgccagacccgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcacguacgaccacgacgucuaccgggacgaggcccucaacaaccgcuuccagaucaaggggguggagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 180 - RNA, 1701 nt, Artificial Sequence; identical to SEQ ID NO: 138
  derived and/or modified CDS sequence (AUadapt) from InfluenzaA__EPI377499__HA

SEQ ID NO: 181 - RNA, 1701 nt, Artificial Sequence
  derived and/or modified CDS sequence (AUadapt) from InfluenzaA__EPI391247__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccucgggcacccuggaguucaacaacgaguccuucaacuggaacggggugacgcagaacggcaccagcuccgccugcauccggcgcucgaacaacuccuucuucagccggcugaacuggcucacccaccugaacuucaaguaccccgcccugaacgugaccaugcccaacaacgagcaguucgacaagcucuacaucuggggcguccaccaccccgugacggacaaggaccagaucuuccuguacgcgcagccguccgggcgcaucaccgugagcaccaagcggucccagcaggccgucauccccaacaucggguuccgcccccggauccgcaacauccccucgcggaucagcaucuacuggaccaucgugaagccgggcgacauccugcucaucaacuccacgggcaaccugaucgcgccccgcggguacuucaagauccggucgggcaaguccagcaucaugcgcuccgacgcccccaucgggaagugcaagagcgagugcaucacccccaacggcuccaucccgaacgacaagcccuuccagaacgugaaccggaucaccuacggcgccugcccccgcuacgucaagcagucgacccugaagcucgccacggggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagagcacccaggcggccaucgaccagaucaacggcaagcugaaccggcugaucgggaagaccaacgagaaguuccaccagaucgagaaggaguucuccgaggucgagggccgcauccaggaccuggagaaguacguggaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 182 - RNA, 1701 nt, Artificial Sequence
  derived and/or modified CDS sequence (AUadapt) from InfluenzaA__EPI407123__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggaacggggugacgcagaacggcaccucguccgccugcauccggcgcagcaacaacuccuucuucucgcggcugaacuggcucacccaccugaacuucaaguaccccgcccugaacgugaccaugcccaacaacgagcaguucgacaagcucuacaucuggggcguccaccaccccgugacggacaaggaccagaucuuccuguacgcgcagccguccgggcgcaucaccgugagcaccaagcggucccagcaggccgucauccccaacaucggguuccgcccccggauccgcaacaaccccagccggaucucgaucuacuggaccaucgugaagccgggcgacauccugcucaucaacuccacgggcaaccugaucgcgccccgcggguacuucaagauccggagcggcaaguccucgaucaugcgcuccgacgcccccaucgggaagugcaagagcgagugcaucacccccaacggcuccaucccgaacgacaagcccuuccagaacgugaaccggaucaccuacggcgccugcccccgcuacgucaagcagucgacccugaagcucgccacggggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagagcacccaggcggccaucgaccagaucaacggcaagcugaaccggcugaucggggagaccaacgagaaguuccaccagaucgagaaggaguucuccgaggucgagggccgcauccaggaccuggagaaguacguggaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 183 - RNA, 1701 nt, Artificial Sequence
  derived and/or modified CDS sequence (AUadapt) from InfluenzaA__EPI407126__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggaacggggugacgcagaacggcaccucguccgccugcauccggcgcagcaacaacuccuucuucucgcggcugaacuggcucacccaccugaacuucaaguaccccgcccugaacgugaccaugcccaacaacgagcaguucgacaagcucuacaucuggggcguccaccaccccgugacggacaaggaccagaucuuccuguacgcgcagccguccgggcgcaucaccgugagcaccaagcggucccagcaggccgucauccccaacaucggguuccgcccccggauccgcaacaaccccagccggaucucgaucuacuggaccaucgugaagccgggcgacauccugcucaucaacuccacgggcaaccugaucgcgccccgcggguacuucaagauccggagcggcaaguccucgaucaugcgcuccgacgcccccaucgggaagugcaagagcgagugcaucacccccaacggcuccaucccgaacgacaagcccuuccagaacgugaaccggaucaccuacggcgccugcccccgcuacgucaagcagucgacccugaagcucgccacggggaugcggaacgugcccgagaagcagacccgcggcaucuucggggccaucgccggcuucaucgagaacgggugggagggcaugguggacggcugguacggguuccggcaccagaacuccgagggccgcgggcaggccgccgaccucaagagcacccaggcggccaucgaccagaucaacggcaagcugaaccggcugaucgggaagaccaacgagaaguuccaccagaucgagaaggaguucuccgaggucgagggccgcauccaggaccuggagaaguacguggaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 184 - RNA, 1701 nt, Artificial Sequence
  derived and/or modified CDS sequence (AUadapt) from InfluenzaA__ACD47234__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucguccugcauccgcgggagcaacaacuccuucuucucgcggcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccgcaucaccgugagcacgaagcggucgcagcagaccgugauccccaacaucggcucccgcccccggguccgcaacauccccagccggaucuccaucuacuggaccaucgugaagccgggggacauccugcugaucaacucgaccggcaaccucaucgcgccccgcggguacuucaagauccgguccggcaagagcuccaucaugcgcucggacgcccccaucggcaagugcaacuccgagugcaucacgcccaacgggagcaucccgaacgacaagcccuuccagaacgugaaccggaucaccuacggcgccugcccccgcuacgucaagcagaacacccugaagcuggccaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccucaagucgacccaggccgcgaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacaugggcaacgggugcuucaagaucuaccacaagugcgacaacgccugcaucggcucgauccggaacgggaccuacgaccacgacgucuaccgcgacgaggcgcugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 185 - RNA, 1701 nt, Artificial Sequence; identical to SEQ ID NO: 69
  derived and/or modified CDS sequence (AUadapt) from InfluenzaA__EPI562037__HA

SEQ ID NO: 186 - RNA, 1710 nt, Artificial Sequence
  derived and/or modified CDS sequence (AUadapt) from InfluenzaA__EPI562034__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucugagugcacuga

SEQ ID NO: 187 - RNA, 1701 nt, Artificial Sequence
  derived and/or modified CDS sequence (AUadapt) from InfluenzaA__EPI653140__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcuccugcuaccccuacgacgugccggacuacgcgucgcugcgcucccuggucgccagcuccggcacccucgaguucaacaacgagucguucaacuggacgggggugacccagaacggcaccuccagcgccugcauccggcgcuccucguccagcuucuucucccggcugaacuggcugacccaccucaacuacaaguaccccgcccugaacgugacgaugcccaacaacgagcaguucgacaagcuguacaucuggggcguccaccaccccgggaccgacaaggaccagaucuucccguacgcgcagucgagcgggcgcaucaccguguccaccaagcggucgcagcaggccgugauccccaacaucggcucccgcccccggauccgcggcauccccagccggaucuccaucuacuggacgaucgucaagccgggggacauccuccugaucaacucgaccggcaaccugaucgcgccccgcggguacuucaagauccgguccggcaagagcuccaucaugcgcucggacgcccccaucggcaagugcaaguccgagugcaucacccccaacgggagcaucccgaacgacaagcccuuccagaacgugaaccggaucaccuacggcgccugcccccgcuacgugaagcacuccacgcucaagcuggccaccgggaugcggaacguccccgagaagcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcucaaccggcugaucggcaagacgaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacaccaucgaccugaccgacucggagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggcuacaaggacuggauccuguggaucagcuucgccaucuccugcuuccugcugugcguggcccuccugggguucaucaugugggccugccagaagggcaacauccgcugcaacaucugcaucuga

SEQ ID NO: 188 - RNA, 1707 nt, Artificial Sequence
  derived and/or modified CDS sequence (AUadapt) from InfluenzaA__ACR48873/m__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucgagaagaacuccaccuaccccacgaucaagcggucguacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagucgaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacucgccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagucggugcggaacggcaccuacgacuacccccaguacuccgaggaggcccgccucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 189 - RNA, 1707 nt, Artificial Sequence
  derived and/or modified CDS sequence (AUadapt) from InfluenzaA__ACR48874/m__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccacgaucaagcggucguacaacaacaccaaccaggaggaccuccuggugcugugggggauccaccaccccaaggacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagucgaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacucgccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagucggugcggaacggcaccuacgacuacccccaguacuccgaggaggcccgccucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 190 - RNA, 1707 nt, Artificial Sequence
  derived and/or modified CDS sequence (AUadapt) from InfluenzaA__ACZ36881__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccucgggcgucuccagcgccugcccguaccagggccgcuccucguucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccagaacccgaccaccuacaucucggugggcacguccacccugaaccagcgccucgugcccaagaucgccacccggagcaaggucaacgggcaguccggccgcauggaguucuucuggaccauccugaagcccaacgacgcgaucaacuucgagucgaacgggaacuucaucgcccccgagaacgccuacaagaucgugaagaagggcgacagcacgaucaugaaguccgagcuggaguacggcaacugcaacaccaagugccagaccccgaucggggccaucaacucguccaugcccuuccacaacauccacccccucaccaucggcgagugccccaaguacgucaagagcaaccggcuggugcuggccacggggcuccgcaacuccccgcagggcgagcggcgccggcgcaagcggggccuguucggggcgaucgccggcuucaucgagggcggguggcaggggaugguggacggcugguacggcuaccaccacucgaacgagcagggguccggcuacgccgccgacaaggagucgacccagaaggccaucgacggggugaccaacaaggucaacuccaucaucgacaagaugaacacccaguucgaggcggugggccgcgaguucaacaaccuggagcggcgcaucgagaaccucaacaagaagauggaggacggguuccuggacguguggacguacaacgccgagcugcucguccugauggagaacgagcggacccuggacuuccacgacagcaacgugaagaaccucuacgacaagguccgccugcagcugcgggacaacgccaaggagcucggcaacggcugcuucgaguucuaccaccgcugcgacaacgagugcauggaguccgugcgcaacgggaccuacgacuacccccaguacucggaggaggcccggcugaagcgcgaggagaucuccggcgugaagcuggagagcaucgggaccuaccagauccucuccaucuacucgacggucgccuccagccuggcgcuggccaucaugguggccggccucucccuguggaugugcucgaacgggagccugcagugccggaucugcaucuga

SEQ ID NO: 191 - RNA, 1704 nt, Artificial Sequence
  derived and/or modified CDS sequence (AUadapt) from InfluenzaA__EPI500771__HA
auggagaagaucgugcuccuguucgccaccaucucgcuggucaaguccgaccacaucugcaucggcuaccacgccaacaacucgaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgcucugcgacgaguucacgaacguccccgaguggagcuacaucguggagaaggccaaccccgccaacgaccugugcuaccccgggaacuucaacgacuacgaggagcugaagcaccuccugucccgcaucaaccacuucgagaagauccagaucaucccgaaggacucgugguccgaccacgaggccagccugggcguguccgcggccugcucguaccagggcaacuccagcuucuuccggaacgucguguggcucaucaagaaggacaacgccuaccccaccaucaagaagggguacaacaacaccaaccgcgaggaccugcugauccucuggggcauccaccaccccaacgacgaggccgagcagaccaagcuguaccagaaccccacgaccuacaucuccaucgggaccucgacccugaaccagcggcucgugccgaagaucgcgacgcgcuccaagaucaaccggcagucgggccgcaucgacuucuucuggaccauccugaagcccaacgacgccauccacuucgaguccaacgggaacuucaucgcccccgaguacgccuacaagaucgucaagaagggcgacagcaccaucaugcgguccgagguggaguacggcaacugcaacacccgcugccagacgcccaucggggccaucaacucgagcaugccguuccacaacauccacccccugaccaucggcgagugccccaaguacgugaaguccaacaagcucguccuggcgaccgggcugcggaacucgccccagcgcgagcggcgccggaagcgcggccucuucggcgccaucgccggguucaucgagggcggguggcagggcaugguggacgggugguacggcuaccaccacuccaacgagcagggcagcggguacgccgccgacaaggaguccacccagaaggcgaucgacggcgugacgaacaaggucaacucgaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacuccaacgugaagaaccuguacgacaaggugcggcuccagcugaaggacaacgccaaggagcuggggaacggcugcuucgaguucuaccacaagugcaacaacgagugcauggagucgguccgcaacggcacguacgacuacccgcaguacuccgaggaggcccggcucaagcgcgaggagaucagcggggugaagcuggaguccaucggcaucuaccagauccugucgaucuacuccaccgucgcgagcucccucgugcuggccaucaugauggccgggcugucgcucuggaugugcuccaacggcagccugcagugccgcaucugcaucuga

SEQ ID NO: 192 - RNA, 1695 nt, Artificial Sequence
  derived and/or modified CDS sequence (AUadapt) from InfluenzaA__ABF93441__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccucgggcgucuccagcgccugcccguaccagggccgcuccucguucuuccggaacgugguguggcugaucaagaagaacaacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggucgaaggucaacgggcaguccggccgcauggaguucuucuggaccauccugaagcccaacgacgcgaucaacuucgagagcaacgggaacuucaucgcccccgagaacgccuacaagaucgugaagaagggcgacucgacgaucaugaaguccgagcuggaguacggcaacugcaacaccaagugccagaccccgaucggggccaucaacagcuccaugcccuuccacaacauccacccccucaccaucggcgagugccccaaguacgucaagucgaaccggcuggugcuggccacggggcuccgcaacuccccgcagaucgagacccggggccuguucggcgcgaucgccggguucaucgagggcggguggcagggcaugguggacgggugguacggcuaccaccacagcaacgagcagggcuccggguacgccgccgacaaggagucgacccagaaggccaucgacggcgugaccaacaaggucaacuccaucaucgacaagaugaacacgcaguucgaggcgguggggcgcgaguucaacaaccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccaccgcugcgacaacgagugcauggaguccgugcggaacggcaccuacgacuacccccaguacucggaggaggcccgccugaagcgggaggagaucuccggggugaagcuggagagcaucggcacguaccagauccucuccaucuacucgaccgucgccuccagccuggcgcuggccaucaugguggccgggcucucccuguggaugugcucgaacggcagccugcagugccgcaucugcaucuga

SEQ ID NO: 193 - RNA, 1707 nt, Artificial Sequence
  derived and/or modified CDS sequence (AUadapt) from InfluenzaA__AGG12577__HA
auggagaagaucgugcugcuguucgccaucaucucgcuggucaaguccgaccacaucugcaucggcuaccacgccaacaacagcaccgagcaggucgacaccaucauggagaagaacgugacggugacccacgcgcaggacauccuggagaagacccacaacgggaagcucugcgaccugaacggcgugaagccccugauccucaaggacugcuccguggccggguggcugcugggcaacccgaugugcgacgaguucaucgacguccccgaguggucguacaucguggagaaggccaaccccgccaacgaccucugcuaccccgggaacuucaacgacuacgaggagcugaagcaccuccucucccgcaucaaccacuucgagaagauccggaucaucccgaaggacagcuggcccgaccacgaggccucccugggcgugagcgcggccugcuccuaccagggcaacucguccuucuuccgcaacgucguguggcugcucaagaaggacaacgccuaccccaucaucaagaaguccuacaacaacaccaacaaggaggaccugcuggugcucugggggauccaccaccccaacgacgaggccgagcagacgcggcuguaccagaacccgaccaccuacgucagcaucggcaccucgacgcugaaccagcgccucgugccccggaucgcgacccgcuccaaggugaacgggcagagcggccggaucgacuucuucuggaccauccugaagcccaacgacgccaucaacuucgaguccaacgggaacuucaucgcccccgaguacgccuacaagaucgucaagaagggcgacagcaccaucaugcgcuccgagguggaguacggcaacugcucgacgcggugccagaccccgaugggggccaucaacagcuccaugcccuuccacaacauccacccccugaccaucggcgagugccccaaguacgucaagagcaacaagcucgugcuggcgaccgggcugcgcaacuccccgcagaucgagcggcgccggcgcaagcggggccucuucggcgccaucgccggguucaucgagggcggguggcagggcaugguggacgggugguacggcuaccaccacucgaacgagcagggcuccggguacgccgccgacaaggagagcacgcagaaggcgaucgacggcgugaccaacaaggucaacuccaucaucgacaagaugaacacccaguucgaggccguggggcgcgaguucaacaaccuggagcggcgcaucgagaaccugaacaagaagauggaggacggcuuccucgacguguggaccuacaacgccgagcugcugguccucauggagaacgagcggacgcuggacuuccacgacucgaacgugaagaaccuguacgacaagguccgccuccagcugcgggacaacgccaaggagcuggggaacggcugcuucgaguucuaccacaagugcgacaacgagugcauggaguccgugcgcaacggcaccuacgacuacccccaguacagcgaggaggcccgccucaagcgggaggagaucuccggggugaagcuggagagcaucggcaccuaccagauccuguccaucuacucgaccgucgcguccagccucgugcuggccaucaugguggccgggcugucccucuggaugugcagcaacggcucccugcagugccgcaucugcaucuga

SEQ ID NO: 194 - RNA, 1707 nt, Artificial Sequence; identical to SEQ ID NO: 193
  derived and/or modified CDS sequence (AUadapt) from InfluenzaA__AGC13463__HA

SEQ ID NO: 195 - RNA, 1707 nt, Artificial Sequence
  derived and/or modified CDS sequence (AUadapt) from InfluenzaA__ACI06178/m1__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggcccucgcacgaggccucccugggcgugagcgccgcgugccccuaccagggcaaguccucguucuuccgcaacguggucuggcugaucaagaagaacaacaccuaccccacgaucaagcgguccuacaacaacaccaaccaggaggaccuccuggugaugugggggauccaccacccgaacgacgccgccgagcagaccaaccuguaccagaaccccaccacguacaucagcgugggcaccuccacccucaaccagcgccugaccccgcggaucgccacgcgcucgaaggucaacgggcaguccggccggauggaguucuucuggaccauccugaagcccaacgacgcgaucaacuucgagagcaacgggaacuucaucgccccggaguacgccuacaagaucgugaagaagggcgacuccaccaucaugaaguccgagcucgaguacggcaacugcaacaccaagugccagacgcccaugggggccaucaacucguccaugcccuuccacaacauccacccccugaccaucggcgagugcccgaaguacgucaagagcaaccgccuggugcucgccaccgggcugcggaacucgccccagcgcgagggccggcgcaagaagcggggccuguucggggcgaucgccggcuucaucgagggcggguggcaggggaugguggacggcugguacggcuaccaccacagcaacgagcagggguccggcuacgccgccgacaaggagucgacccagaaggccaucgacggggugacgaacaaggucaacuccaucaucgacaagaugaacacccaguucgaggcggugggccgcgaguucaacaaccucgagcggcgcaucgagaaccugaacaagaagauggaggacggguuccuggacguguggaccuacaacgccgagcuccugguccugauggagaacgagcggacccucgacuuccacgacagcaacgugaagaaccuguacgacaagguccgccugcagcuccgggacaacgccaaggagcugggcaacggcugcuucgaguucuaccacaagugcgacaacgagugcauggaguccgugcgcaacgggacguacgacuacccccaguacucggaggaggcccggcugaagcgcgaggagaucuccggcgugaagcucgagagcaucgggaucuaccagauccuguccaucuacucgaccgucgccuccagccuggcgcucgccaucaugguggccggccugucccuguggaugugcagcaacgggucccuccagugccgcaucugcaucuga

SEQ ID NO: 196 - RNA, 1707 nt, Artificial Sequence
  derived and/or modified CDS sequence (AUadapt) from InfluenzaA__AHF20402__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugcgcccccugauccuccgggacugcuccgucgccggguggcugcugggcaacccgaugugcgacgaguucaucaacgugcccgaguggucguacaucguggagaaggccaaccccgucaacgaccucugcuaccccgggguguucaacgacuacgaggagcugaagcaccuccucucccgcaucaaccacuucgagaagauccagaucaucccgaagaacagcuggcccucccacgaggccagccugggcguguccgccgcgugccccuaccagggccagucguccuucuuccggaacgucguguggcugaucaagaagaacaacaccuaccccacgaucaagcgcagcuacaacaacaccaaccaggaggaccuccuggugaugugggggauccaccacccgaacgacgccgucgagcagaccaagcuguaccagaaccccaccacguacaucuccgugggcaccucgacccucaaccagcggcugacgccccgcaucgccacccgguccaaggugaaggggcugagcggccgcauggaguucuucuggaccauccucaagcccaacgacgccaucaacuucgaguccaacgggaacuucaucgcgccggaguacgccuacaagaucgucaagaagggcgacagcaccaucaugcgguccgagcuggaguacggcaacugcaacaccaagugccagacgcccaugggggccaucaacucgagcaugcccuuccacaacauccacccccugaccaucggcgagugcccgaaguacgugaaguccacccgccucgugcuggccaccgggcugcggaacagcccccagcgcgaggagcggcgcaagaagcggggccucuucggcgccaucgcgggguucaucgagggcggguggcagggcauggucgacgggugguacggcuaccaccacuccaacgagcagggcucgggguacgccgccgacaaggaguccacgcagaaggccaucgacggcgugaccaacaaggugaacagcaucaucgacaagaugaacacccaguucgaggccgucgggcgcgaguucaacaaccuggagcggcgcaucgagaaccugaacaagaagauggaggacggcuuccucgacguguggaccuacaacgcggagcugcugguccucauggagaacgagcggacgcuggacuuccacgacuccaacgugaagaaccuguacgacaaggugcgccuccagcugcgggacaacgccaaggagcuggggaacggcugcuucgaguucuaccacaagugcgacaacaagugcauggagucgguccgcaacggcaccuacgacuacccccaguacuccgaggaggcccgccucaagcgggaggagaucagcggggugaagcuggaguccaucggcguguaccagauccugagcaucuacuccaccgucgccucgucccucgcccuggcgaucaugguggccgggcugagccucuggaugugcuccaacggcagccugcagugccgcaucugcaucuga

SEQ ID NO: 197 - RNA, 1707 nt, Artificial Sequence
  derived and/or modified CDS sequence (AUadapt) from InfluenzaA__ABQ45850__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccucgggcgucuccagcgccugcccguaccagggccgcuccucguucuuccggaacgugguguggcugaucaagaagaacgacgcguaccccaccaucaagcgcuccuacaacaacacgaaccaggaggaccugcugguccucugggggauccaccaccccaacgacgccgccgagcagacccggcuguaccagaacccgaccaccuacaucucggugggcacguccacccugaaccagcgccucgugcccaagaucgccacccggagcaaggucaacgggcaguccggccgcauggaguucuucuggaccauccugaagcccaacgacgcgaucaacuucgagucgaacgggaacuucaucgcccccgagaacgccuacaagaucgugaagaagggcgacagcacgaucaugaaguccgagcuggaguacggcaacugcaacaccaagugccagaccccgaucggggccaucaacucguccaugcccuuccacaacauccacccccucaccaucggcgagugccccaaguacgucaagagcaaccggcuggugcuggccacggggcuccgcaacuccccgcagggcgagcggcgccggaagaagcgcggccuguucggggcgaucgccggcuucaucgagggcggguggcaggggaugguggacggcugguacggcuaccaccacucgaacgagcagggguccggcuacgccgccgacaaggagucgacccagaaggccaucgacggggugaccaacaaggucaacuccaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacucggaggaggcccgccugaagcgggaggagaucuccggcgugaagcuggagagcaucgggaccuaccagauccucuccaucuacucgacggucgccuccagccuggcgcuggccaucaugguggccggccucucccuguggaugugcucgaacgggagccugcagugccgcaucugcaucuga

SEQ ID NO: 198 - RNA, 1713 nt, Artificial Sequence
  derived and/or modified CDS sequence (AUadapt) from InfluenzaA__AKI82373__HA
auggagaagaucgugccccugcucgccaucaucggccuggucaagucggaccagaucugcaucggguaccacgccaacaacuccaccgagcaggucgacaccaucauggagaagaacgugacggugacccacgcgcaggacauccuggagaagacccacaacggcaagcucugcaaccuggacggggugaagccgcugauccucaaggacugcagcguggccggcuggcugcuggggaaccccaugugcgacgaguuccucaacgucuccgaguggucguacaucguggagaaggccucccccgccaacggccugugcuaccccggcgacuucaacgacuacgaggagcugaagcaccuccugaaccgcaucacccaccugaagaagaucaagaucauccccaagagcuacugguccaaccacgaggccucguccggggugagcgcggccugcuccuacaugggcgagcccagcuucuuccggaacgucguguggcucaucaagaagaacaacacguacccgcccaucaaggugaacuacaccaacaccaaccaggaggaccugcugguccucugggggauccaccacccgaacaacgaggccgagcagauccagaucuaccagaaccugaucacccacaucuccgugggcacgucgacccugaaccagcgccucauccccaagaucgccacccgguccaaggugaacgggcagagcggccgcauggaguucuucuggaccauccugaagcccaacgacuccaucaacuucgacucgaacggcaacuucaucgcgcccgaguacgccuacaucgucaagaagggggacuccgccaucaugaaguccgagcuggaguacggcaacugcaacacgaagugccagaccccgaugggggccaucaacagcucgaugcccuuccacaacauccacccccucaccaucggcgagugccccaaguacgucaagagcaaccggcuggugcuggccaccggccuccgcaacgcgccgcagcgggagcgcgagggcgggcggcgccggaagcgcgggcuguucggcgccaucgccggguucaucgagggcggcuggcaggggaugguggacggcugguacggguaccaccacuccaacgagcagggcagcggguacgccgccgacaaggaguccacgcagaaggcgaucgacggcaucaccaacaaggugaacucgaucaucgacaagaugaacacccaguucgaggccgugggccgggaguucaacaaccuggagcgccggaucgagaaccucaacaagaagauggaggacggguuccuggacgucuggaccuacaacgccgagcugcucgugcugauggagaacgagcgcacgcuggacuuccacgacuccaacgugaagaaccucuacgagaagguccggcugcagcugcgcgacaacgccaaggagcucggcaacgggugcuucgaguucuaccacaagugcgacaacgagugcauggagagcgugcggaacggcaccuacgacuacucccaguacucggaggaggcccgccugucccgggaggagaucaacggggucaagcuggagagcauggugaccuaccagauccucuccaucuacucgaccguggcguccagccuggcccuggccaucauggucgccggccucucccuguggaugugcagcaacggcucccugcagugccgcaucugcaucuga

SEQ ID NO: 199 - RNA, 1713 nt, Artificial Sequence
  derived and/or modified CDS sequence (AUadapt) from InfluenzaA__EPI284473__HA
auggagaagaucgugcugcuccuggccaucaucucgcuggucaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugaaggacugcuccguggccggguggcugcucggcaacccgaugugcgacgaguuccugaacgucucggagugguccuacaucguggagaaggccagccccgccaacgggcugugcuaccccggcgacuucaacgacuacgaggagcucaagcaccuccugaaccgcaucacccaccugaagaagaucaagaucauccccaaguccuacuggagcaaccacgaggccuccucgggcguguccgcggccugcagcuacaugggggagccguccuucuuccggaacgucguguggcugaucaagaagaacaacacguacccgcccaucaaggugaacuacaccaacaccaaccaggaggaccugcucguccuguggggcauccaccaccccaacaacgaggccgagcagauccagaucuaccagaaccugaucacccacaucagcguggggacguccacccucaaccagcgccugauccccaagaucgccacccggucgaaggugaacggccaguccgggcgcauggaguucuucuggaccauccugaagcccaacgacagcaucaacuucgacuccaacggcaacuucaucgcgcccgaguacgccuacaucgucaagaagggcgacagcgccaucaugaaguccgagcucgaguacgggaacugcaacacgaagugccagacccccaugggcgccaucaacucgagcaugccguuccacaacauccacccccugaccaucggggagugccccaaguacgugaaguccaaccggcuggugcucgccaccggccugcgcaacgcgccccagcgggagcgcgagggcgggcggcgccggaagcgcggccuguucggggccaucgccggcuucaucgagggcggguggcagggcauggucgacgggugguacggcuaccaccacucgaacgagcagggguccggcuacgccgccgacaaggagagcacgcagaaggcgaucgacgggaucaccaacaaggugaacuccaucaucgacaagaugaacacccaguucgaggccgugggccgggaguucaacaaccucgagcgccggaucgagaaccugaacaagaagauggaggacggcuuccuggacgucuggaccuacaacgccgagcuccuggugcugauggagaacgagcgcacgcucgacuuccacgacagcaacgugaagaaccuguacgagaagguccggcugcagcuccgcgacaacgccaaggagcuggggaacggcugcuucgaguucuaccacaagugcgacaacgagugcauggaguccgugcggaacgggaccuacgacuacucgcaguacuccgaggaggcccgccugagccgggaggagaucaacggcgucaagcucgaguccauggugaccuaccagauccugagcaucuacuccaccguggcgucgucccuggcccucgccaucauggucgccgggcugagccuguggaugugcuccaacggcagccuccagugccgcaucugcaucuga

SEQ ID NO: 200 - RNA, 1710 nt, Artificial Sequence
  derived and/or modified CDS sequence (AUadapt) from InfluenzaA__ACO07033__HA
auggagaagaucgugcugcuccuggccaugaucggccuggucaagucggaccagaucugcaucggguaccacgccaacaacuccaccgagcaggucgacaccaucauggagaagaacgugacggugacccacgcgcaggacauccucgagaagacccacaacggcaagcugugcaaccuggacggggugaagccccucauccugaaggacugcagcguggccggcuggcugcucgggaacccgaugugcgacgaguuccugaacgucuccgaguggucguacaucguggagaaggccucccccgccaacggccugugcuaccccggcgacuucaacgacuacgaggagcucaagcaccuccugagccgcaucaaccaccugaagaagaucaagaucauccccaaguccuacuggucgaaccacgaggccuccagcgggguguccgcggccugcagcuaccugggcgagccguccuucuuccggaacgucguguggcugaucaagaagaacaacaccuacccgcccaucaaggugaacuacacgaacaccaaccaggaggaccuccugguccugugggggauccaccaccccaacgacgagaaggagcagauccgcaucuaccagaaccccaacaccucgaucuccgugggcaccagcacgcucaaccagcggcuggugcccaagaucgccacccgccccaaggucaacgggcaguccggccggauggaguucuucuggaccauccugaagcccaacgacucgaucaacuucgacuccaacggcaacuucaucgccccggaguacgcguacaagaucgccaagaagggggacagcgugaucaugaaguccgagcucgaguacggcaacugcaacaccaagugccagacgcccaugggggccaucaacagcucgaugcccuuccacaacauccacccccugaccaucggcgagugcccgaaguacgugaaguccaaccgccugguccucgccaccggccugcggaacgcgccccagcgcgagggcgggcggcgccggaagcgcgggcuguucggcgccaucgccggguucaucgagggcggcuggcaggggaugguggacggcugguacggguaccaccacagcaacgagcagggcuccggguacgccgccgacaaggagucgacccagaaggccaucgacggcaucacgaacaaggugaacuccaucaucgacaagaugaacacccaguucgagaucgucggccgggaguucaacaaccucgagcgccggaucgagaaccugaacaagaagauggaggacggguuccuggacguguggaccuacaacgcggagcuccuggugcugauggagaacgagcgcacccucgacuuccacgacagcaacgucaagaaccuguacgagaaggugcggcugcagcuccgcgacaacgccaaggagcugggcaacgggugcuucgaguucuaccacaagugcgacaacgagugcauggaguccguccggaacggcacguacgacuacccccaguacagcgaggaggcccgccugucccgggaggagaucucgggggugaagauggaguccauggugaccuaccagauccucagcaucuacuccaccgucgccucgucccuggcccuggcgaucaugguggccggccucagccuguggaugugcuccaacggcagccugcagugccgcaucugcaucuga

SEQ ID NO: 201 - RNA, 1695 nt, Artificial Sequence
  derived and/or modified CDS sequence (AUadapt) from InfluenzaA__EPI174803__HA
auggagaagaucgugcugcuccuggccaugaucggccuggucaagucggaccagaucugcaucggguaccacgccaacaacuccaccgagcaggucgacaccaucauggagaagaacgugacggugacccacgcgcaggacauccucgagaagacccacaacggcaagcugugcaaccuggacggggugaagccccucauccugaaggacugcagcguggccggcuggcugcucgggaacccgaugugcgacgaguuccugaacgucuccgaguggucguacaucguggagaaggccucccccgccaacggccugugcuaccccggcgacuucaacgacuacgaggagcucaagcaccuccugagccgcaucaaccaccugaagaagaucaagaucauccccaaguccuacuggucgaaccacgaggccuccagcgggguguccgcggccugcagcuaccugggcgagccguccuucuuccggaacgucguguggcugaucaagaagaacaacaccuacccgcccaucaaggugaacuacacgaacaccaaccaggaggaccuccugguccugugggggauccaccaccccaacgacgagaaggagcagauccgcaucuaccagaaccccaacaccucgaucuccgugggcaccagcacgcucaaccagcggcuggugcccaagaucgccacccgccccaaggucaacgggcaguccggccggauggaguucuucuggaccauccugaagcccaacgacucgaucaacuucgacuccaacggcaacuucaucgccccggaguacgcguacaagaucgccaagaagggggacagcgugaucaugaaguccgagcucgaguacggcaacugcaacaccaagugccagacgcccaugggggccaucaacagcucgaugcccuuccacaacauccacccccugaccaucggcgagugcccgaaguacgugaaguccaaccgccugguccucgccaccggccugcggaacgcgccccagaccgagacgcgcgggcuguucggcgccaucgccggguucaucgagggcggguggcagggcaugguggacggcugguacggguaccaccacagcaacgagcagggcuccggguacgccgccgacaaggagucgacccagaaggccaucgacggcaucaccaacaaggugaacuccaucaucgacaagaugaacacccaguucgagaucgucgggcgggaguucaacaaccucgagcgccggaucgagaaccugaacaagaagauggaggacggcuuccuggacguguggacguacaacgcggagcuccuggugcugauggagaacgagcgcacccucgacuuccacgacagcaacgucaagaaccuguacgagaaggugcggcugcagcuccgcgacaacgccaaggagcugggcaacgggugcuucgaguucuaccacaagugcgacaacgagugcauggaguccguccggaacggcaccuacgacuacccccaguacagcgaggaggcccgccugucccgggaggagaucucgggggugaagauggaguccauggugaccuaccagauccucagcaucuacuccacggucgccucgucccuggcccuggcgaucaugguggccggccucagccuguggaugugcuccaacgggagccugcagugccgcaucugcaucuga

SEQ ID NO: 202 - RNA, 1704 nt, Artificial Sequence
  derived and/or modified CDS sequence (AUadapt) from InfluenzaA__AGZ62382__HA
auggagaagaucgugcugcuguucgccgccaucucgcuggucaaguccgaccacaucugcaucggcuaccacgcgaacaacucgaccaagcaggucgacaccaucauggagaagaacgugacggugacccacgcccaggacauccuggagaagacccacaacgggaagcucugcgaccugaacggcgugaagccccugauccucaaggacugcuccguggccggguggcugcugggcaacccgaugugcgacgaguucaucaacguccccgaguggagcuacaucguggagaaggccaaccccgccaacgggcucugcuaccccggcaacuucaacgacuacgaggagcugaagcaccuccucucccgcaucaaccacuucgagaagauccggaucaucccgaaggacucgugguccgaccacgaggcgagccugggcguguccgccgccugccccuaccaggggaacucguccuucuuccgcaacgucguguggcugaucaagaaggacaacaccuaccccacgaucaagaaguccuacaacaacaccaaccaggaggaccuccugauccuguggggcauccaccaccccaacgacgaggccgagcagacccggcucuaccagaacccgaccacguacaucagcaucgggaccucgacccugaaccagcgccuggugcccaagaucgcgacccgguccaagaucaacggccagagcgggcgcaucgacuucuucuggacgauccucaagcccaacgacgccauccacuucgaguccaacggcaacuucaucgcccccgaguacgccuacaagaucgucaagaagggcgacucgaccaucaugaaguccgagguggaguacgggaacugcaacacccggugccagaccccgaucggcgccaucaacagcucgaugcccuuccacaacauccacccccugacgaucggggagugccccaaguacgugaaguccaacaagcugguccucgcgaccggccugcgcaacagcccgcagcgggagcgccggcgcaagcggggccuguucggggccaucgccggcuucaucgagggcggguggcaggggaugguggacggcugguacggcuaccaccacuccaacgagcaggggucgggcuacgccgccgacaaggaguccacccagaaggcgaucgacggggugaccaacaaggucaacagcaucaucgacaagaugaacacgcaguucgaggccgugggccgcgaguucaacaaccucgagcggcgcaucgagaaccugaacaagaagauggaggacggguuccuggacguguggaccuacaacgccgagcuccugguccugauggagaacgagcggacccucgacuuccacgacuccaacgugcgcaaccuguacgacaaggugcggcugcagcucaaggacaacgccaaggagcugggcaacggcugcuucgaguucuaccacaagugcaacaacgagugcauggagucgguccgcaacgggaccuacgacuacccccaguacuccgaggaggcccggcugcgccgcgaggagaucagcggcgugaagcucgaguccaucgggaucuaccagauccugucgaucuacuccacggucgcgagcucccuggugcucgccaucaugauggccggccugucgcuguggaugugcuccaacgggagccuccagugccggaucugcaucuga

SEQ ID NO: 203 - RNA, 1704 nt, Artificial Sequence
  derived and/or modified CDS sequence (AUadapt) from InfluenzaA__ABG67978/m__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagucguccuggagcgaccacgaggccuccucgggcgucuccagcgcgugcccguaccagggcacccccuccuucuuccgcaacgugguguggcugaucaagaagaacaacacguaccccaccaucaagcggucguacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggucgaaggugaacgggcaguccggccgcauggacuucuucuggaccauccucaagcccaacgacgcgaucaacuucgagagcaacgggaacuucaucgcccccgaguacgccuacaagaucgucaagaagggcgacucggccaucaucaaguccgagguggaguacggcaacugcaacaccaagugccagaccccgaucggggccaucaacagcuccaugcccuuccacaacauccacccccugacgaucggcgagugccccaaguacgucaagucgaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagucgacccagaaggcgaucgacggcgugaccaacaaggucaacuccaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacucggaggaggcccgccucaagcgggaggagaucuccggggugaagcuggagagcaucggcacguaccagauccuguccaucuacucgaccgucgcguccagccucgcccuggccaucaugguggccgggcugucccucuggaugugcucgaacggcagccugcagugccgcaucugcaucuga

SEQ ID NO: 204 - RNA, 1695 nt, Artificial Sequence
  derived and/or modified CDS sequence (AUadapt) from InfluenzaA__EPI827075__HA
auggagaagaucgugcuccuguucgccaccaucucgcuggucaaguccgaccacaucugcaucggcuaccacgccaacaacucgaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgcucugcgacgaguucacgaacguccccgaguggagcuacaucguggagaaggccaaccccgccaacgaccugugcuaccccgggaacuucaacgacuacgaggagcugaagcaccuccugucccgcaucaaccacuucgagaagauccagaucaucccgaaggacucgugguccgaccacgaggccagccugggcguguccgcggccugcucguaccagggcaacuccagcuucuuccggaacgucguguggcucaucaagaaggacaacgccuaccccaccaucaagaagggguacaacaacaccaaccgcgaggaccugcugauccucuggggcauccaccaccccaacgacgaggccgagcagacccggcuguaccagaaccccacgaccuacaucuccaucgggaccucgacccugaaccagcgccucgugccgaagaucgcgacgcgguccaagaucaacggccagucggggcgcaucgacuucuucuggaccauccugaagcccaacgacgccauccacuucgaguccaacggcaacuucaucgcccccgaguacgccuacaagaucgucaagaagggcgacagcaccaucaugcgguccgagguggaguacgggaacugcaacacccgcugccagacgcccaucggcgccaucaacucgagcaugccguuccacaacauccacccccugaccaucggggagugccccaaguacgugaaguccaacaagcucguccuggcgaccggccugcggaacucgccccagcgcgagacccggggccucuucggggccaucgccggcuucaucgagggcggguggcaggggaugguggacggcugguacggcuaccaccacuccaacgagcaggggagcggcuacgccgccgacaaggaguccacgcagaaggcgaucgacggggugaccaacaaggucaacucgaucaucgacaagaugaacacccaguucgaggccgugggccgcgaguucaacaaccuggagcggcgcaucgagaaccugaacaagaagauggaggacggguuccucgacguguggaccuacaacgccgagcugcugguccucauggagaacgagcggacgcuggacuuccacgacuccaacgugaagaaccuguacgacaaggugcgccuccagcugaaggacaacgccaaggagcugggcaacggcugcuucgaguucuaccacaagugcaacaacgagugcauggagucgguccggaacgggaccuacgacuacccgcaguacuccgaggaggcccgccucaagcgggaggagaucagcggcgugaagcuggaguccaucgggaucuaccagauccugucgaucuacuccaccgucgcgagcucccucgugcuggccaucaugauggccggccugucgcucuggaugugcuccaacgggagccugcagugccgcaucugcaucuga

SEQ ID NO: 205 - RNA, 1707 nt, Artificial Sequence
  derived and/or modified CDS sequence (AUadapt) from InfluenzaA__ABP96850__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggggacuucaacgacuacgaggagcucaagcaccuccugucccggaucaaccacuucgagaagauccagaucauccccaagucguccuggagcgacuacgaggccuccagcggcgucuccucggccugcccguaccagggccgcuccagcuucuuccggaacgugguguggcugaucaagaagaacaacgcguaccccaccaucaagcgcuccuacaacaacacgaaccaggaggaccugcugguccucugggggauccaccaccccaacgacgccgccgagcagauccggcuguaccagaacccgaccaccuacaucagcgugggcaccuccacgcugaaccagcgccucgugcccaagaucgccacccggucgaaggucaacgggcaguccggccgcauggaguucuucuggaccauccucaagagcaacgacgcgaucaacuucgagagcaacgggaacuucaucgcccccgaguacgccuacaagaucgugaagaagggcgacuccaccaucaugaaguccgagcuggaguacggcaacugcaacacgaagugccagacccccaucggggccaucaacagcucgaugccguuccacaacauccacccccugaccaucggcgagugccccaaguacgugaaguccaaccggcugguccuggccaccgggcuccgcaacagcccccagggcgagcggcgccggcgcaagcggggccuguucggggcgaucgccggcuucaucgagggcggguggcaggggaugguggacggcugguacggcuaccaccacuccaacgagcaggggagcggcuacgccgccgacaaggaguccacgcagaaggccaucgacggggugaccaacaaggucaacucgaucaucaacaagaugaacacccaguucgaggcggugggccgcgaguucaacaaccuggagcggcgcaucgagaaccucaacaagaagauggaggacggguuccuggacguguggaccuacaacgccgagcugcucguccugauggagaacgagcggacgcuggacuuccacgacuccaacgugaagaaccucuacgacaagguccgccugcagcugcgggacaacgccaaggagcucggcaacggcugcuucgaguucuaccaccgcugcgacaacgagugcauggagagcgugcgcaacgggaccuacgacuacccgcaguacuccgaggaggcccggcugaagcgcgaggagaucagcggcgugaagcuggaguccaucgggaucuaccagauccucucgaucuacuccaccgucgccagcucccuggcgcuggccaucaugguggccggccucuuccuguggaugugcagcaacgggagccugcagugccggaucugcaucuga

SEQ ID NO: 206 - RNA, 1692 nt, Artificial Sequence
  derived and/or modified CDS sequence (AUadapt) from InfluenzaA__EPI827077__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaaggacucgugguccgaccacgaggccucgggcgucuccagcgccugccccuaccagggccgcuccucguucuuccggaacgugguguggcugaccaagaagaacgacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcucgaaggucaacgggcaguccggccggauggaguucuucuggacgauccucaagucgaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacucguccaugccguuccacaacauccacccccugacgaucggggagugccccaaguacgucaagagcaaccgccucgugcuggccaccggccugcggaacucgccccagcgcgagacccggggccucuucggggcgaucgccggcuucaucgagggcggguggcaggggaugguggacggcugguacggguaccaccacucgaacgagcagggcuccggcuacgccgccgacaaggagagcacccagcgcgccaucgacggggugacgaacaaggucaacuccaucaucgacaagaugaacacccaguucgaggcggugggccgggaguucaacaaccuggagcgccggaucgagaaccugaacaagaagauggaggacggguuccucgacguguggaccuacaacgccgagcugcugguccucauggagaacgagcgcacccuggacuuccacgacucgaacgugaagaaccuguacgacaagguccggcuccagcugcgcgacaacgccaaggagcugggcaacgggugcuucgaguucuaccaccggugcgacaacgagugcauggaguccgugcgcaacggcacguacgacuacccgcaguacagcgaggaggcccggcucaagcgcgaggagaucuccggcgugaagcuggagucgaucgggaccuaccagauccuguccaucuacucgaccgucgccuccagccucgcgcuggccaucaugguggccggccugucccucuggaugugcucgaacgggagccugcagugccgcaucugcaucuga

SEQ ID NO: 207 - RNA, 1704 nt, Artificial Sequence
  derived and/or modified CDS sequence (AUadapt) from InfluenzaA__EPI594523__HA
auggagaagaucauccugcuccuggccaucaucggccuggucaagucggaccagaucugcgugggguaccacgccaacaacuccaccgagcgcguggacaccaucauggagaagaacgugacggucacccacgcgcaggacauccucgagaagacccacaacggcaagcugugcaaccugaacggggugaagccccucauccuggaggacugcagcguggccggcuggcugcucgggaacccgaugugcgacaaguuccugaacgucuccgaguggucguacaucguggagaaggccggccccgccaacggccugugcuaccccggggacuucaacgacuacgaggagcucaagcaccuccugucccggaucaaccacuucgagaagaucgagaucauccccaagaaccacuggagcaaccacaacaccuccggcgugucguccgccugcagcuaccuggagaacccguccuucuuccgcaacgucguguggcugacgaagaagaacaacaccuaccccaccaucaaggugaacuacaccaacgcgaaccagaaggaccugcucguccugugggggauccaccaccccaacaacgaggccgagcagaagaugaucuaccagaacucgaacacguacguguccgugggcaccagcacccugaaccagcggcucguccccaagaucgccacccgcuccaaggugaacgggcagucgggccggaucgacuucuucuggacgauccugaagccgaacgacaccaucaacuucgacuccaacggcaacuucaucgcccccaaguacgcguacaagaucgugaagaagggggacagcgccaucaugaaguccgagcugaaguacgacaacugcaacaccaagugccagacccccaucggcgccaucaacucgagcaugcccuuccacaacauccacccgcucacgaucggggagugccccaaguacgucaaguccaaccgccuggugcuggccaccggccuccggaacgcgccccagaucgagggccgccggcgcaagcgggggcuguucggcgccaucgccggguucaucgagggcggguggcagggcaugguggacggcugguacggguaccaccacucgaacgagcagggcuccggguacgccgccgacaaggagagcacccagaaggccgucgacggcaucaccaacaagaucaacuccaucaucgacaagaugaacaaccaguucgaggcgguggggcgcgaguucaacaaccuggagcggcgcaucgagaaccucaacaagaagauggaggacggcuuccuggacguguggacguacaacgccgagcugcucguccugauggagaacgagcggacccuggacuuccacgacucgaacgugaagaaccucuacgagaagguccgccugcagcugcgggacaacgccaaggagcucggcaacgggugcuucgaguucuaccacaagugcgacaacgagugcauggaguccgugaagaacggcaccuacgacuacccccaguacagcgaggaggcccgccugaaccgggaggagaucuccggggugaagcuggagucgaccgucacguaccagauccucuccaucuacagcaccguggccuccucgcuggugcuggcgaucauggucgccggccucucccuguggaugugcagcaacgggucccugcagugccgcaucugcaucuga

SEQ ID NO: 208 - RNA, 1707 nt, Artificial Sequence
  derived and/or modified CDS sequence (AUadapt) from InfluenzaA__AAD37782__HA
auggagcgcaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccugaacggcgugaagccccucauccugcgggacugcuccgucgccggguggcugcucggcaacccgaugugcgacgaguucaucaacgugcccgaguggagcuacaucguggagaaggccucccccgccaacgaccugugcuaccccggggacuucaacgacuacgaggagcugaagcaccuccugucgcgcaccaaccacuucgagaagauccagaucaucccgcccuccucgugguccaaccacgacgccagcuccggcgucucguccgcgugccccuaccacggccggagcuccuucuuccgcaacgugguguggcugaucaagaagaacucggccuaccccacgaucaagcgguccuacaacaacaccaaccaggaggaccuccugguccugugggggauccaccacccgaacgacgccgccgagcagaccaagcucuaccagaaccccaccacguacaucucggugggcaccuccacccugaaccagcgccuggugcccgagaucgcgacccggcccaaggucaacgggcagagcggccgcauggaguucuucuggacgauccucaagccgaacgacgccaucaacuucgagucgaacgggaacuucaucgcccccgaguacgccuacaagaucgugaagaagggcgacuccgccaucaugaaguccgagcuggaguacggcaacugcaacaccaagugccagacccccaugggggcgaucaacagcucgaugcccuuccacaacauccacccgcugaccaucggcgagugccccaaguacgugaaguccaaccggcucguccuggccacggggcugcgcaacacgccccagcgggagcgccggcgcaagaagcggggccucuucggcgccaucgccggguucaucgagggcggguggcagggcauggugaacgggugguacggcuaccaccacucgaacgagcagggcuccggguacgccgcggacaaggagagcacccagaaggccaucgacggcgugaccaacaaggucaacuccaucaucgacaagaugaacacccaguucgaggccguggggcgcgaguucaacaaccuggagcggcgcaucgagaaccugaacaagcagauggaggacggcuuccucgacguguggaccuacaacgccgagcugcugguccucauggagaacgagcggacccuggacuuccacgacucgaacgugaagcaccuguacgacaagguccgccuccagcugcgggacaacgccaaggagcuggggaacggcugcuucgaguucuaccacaagugcgacaacgagugcauggaguccgugaagaacggcaccuacgacuacccccaguacagcgaggaggcgcgccucaaccgcgaggagaucuccggggugaagcuggagucgaugggcacguaccagauccuguccaucuacucgaccgucgccuccagccucgcccuggccaucaugguggccgggcugucccucuggaugugcucgaacggcagccugcagugccggaucugcaucuga

SEQ ID NO: 209 - RNA, 1707 nt, Artificial Sequence
  derived and/or modified CDS sequence (AUadapt) from InfluenzaA__AAD51927__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccugaacggcgugaagccccucauccugcgcgacugcuccgucgccggguggcugcucggcaacccgaugugcgacgaguucaucaacgugcccgaguggagcuacaucguggagaaggccucccccgccaacgaccugugcuaccccggggacuucaacgacuacgaggagcugaagcaccuccugucgcggaccaaccacuucgagaagauccagaucaucccgaaguccucgugguccaaccacgacgccagcuccggcgucucguccgcgugccccuaccacggccgcagcuccuucuuccggaacgugguguggcugaucaagaagaacucggccuaccccacgaucaagcgcuccuacaacaacaccaaccaggaggaccuccugguccugugggggauccaccaccccaacgacgccgccgagcagaccaagcucuaccagaacccgaccacguacaucucggugggcaccuccacccugaaccagcggcuggugcccgagaucgcgacccgccccaaggucaacgggcagagcggccggauggaguucuucuggacgauccucaagcccaacgacgccaucaacuucgagucgaacgggaacuucaucgccccggaguacgccuacaagaucgugaagaagggcgacuccgccaucaugaaguccgagcuggaguacggcaacugcaacaccaagugccagacccccaugggggcgaucaacagcucgaugcccuuccacaacauccacccccugaccaucggcgagugcccgaaguacgugaaguccaaccgccucguccuggccacggggcugcggaacacgccccagcgcgagcggcgccggaagaagcgcggccucuucggcgccaucgccggguucaucgagggcggguggcagggcaugguggacgggugguacggcuaccaccacucgaacgagcagggcuccggguacgccgcggacaaggagagcacccagaaggccaucgacggcgugaccaacaaggucaacuccaucaucgacaagaugaacacccaguucgaggccguggggcgggaguucaacaaccuggagcgccggaucgagaaccugaacaagcagauggaggacggcuuccucgacguguggaccuacaacgccgagcugcugguccucauggagaacgagcgcacccuggacuuccacgacucgaacgugaagaaccuguacgacaagguccggcuccagcugcgcgacaacgccaaggagcuggggaacggcugcuucgaguucuaccacaagugcgacaacgagugcauggaguccgugaagaacggcaccuacgacuacccccaguacagcgaggaggcgcggcucaaccgcgaggagaucuccggggugaagcuggagucgaugggcacguaccagauccuguccaucuacucgaccgucgccuccagccucgcccuggccaucaugguggccgggcugucccucuggaugugcucgaacggcagccugcagugccgcaucugcaucuga

SEQ ID NO: 210 - RNA, 1704 nt, Artificial Sequence
  derived and/or modified CDS sequence (AUadapt) from InfluenzaA__AEO89181__HA
auggagaagaucgugcugcuguucgccaccaucucgcuggucaaguccgaccacaucugcaucggcuaccacgccaacaacucgaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgaugugcgacgaguucaucaacguccccgaguggagcuacaucguggagaaggccaaccccgccaacgaccucugcuaccccgggaacuucaacgacuacgaggagcugaagcaccuccucucccgcaucaaccacuucgagaagauccagaucaucccgaagaacucgugguccgaccacgaggccagccugggcguguccgcggccugccccuaccagggcaagucguccuucuuccggaacgucguguggcugaucaagaaggacaacgccuaccccacgaucaagaagggguacaacaacaccaaccaggaggaccuccuggugcuguggggcauccaccaccccaacgacgaggccgagcagacccgccucuaccagaacccgaccacguacaucagcaucgggaccuccacccugaaccagcggcugguccccaagaucgcgacccgcucgaagaucaacggccaguccgggcggaucgacuucuucuggacgauccucaagcccaacgacgccauccacuucgagagcaacggcaacuucaucgcccccgaguacgccuacaagaucgugaagaagggcgacuccaccaucaugaaguccgagguggaguacgggaacugcaacacccgcugccagaccccgaucggcgccaucaacucgucgaugcccuuccacaacauccacccccugacgaucggggagugccccaaguacgucaagagcaacaagcuggugcucgcgaccggccugcggaacuccccgcagcgcgagcggcgccggaagcgcggccuguucggggccaucgccggcuucaucgagggcggguggcaggggaugguggacggcugguacggcuaccaccacucgaacgagcagggguccggcuacgccgccgacaaggagagcacccagaaggcgaucgacggggucaccaacaaggugaacuccaucaucgacaagaugaacacgcaguucgaggccgugggccgggaguucaacaaccucgagcgccggaucgagaaccugaacaagaagauggaggacggguuccuggacgucuggaccuacaacgccgagcuccuggugcugauggagaacgagcgcacccucgacuuccacgacucgaacgugcggaaccuguacgacaagguccgccugcagcucaaggacaacgccaaggagcugggcaacggcugcuucgaguucuaccacaagugcgacaacgagugcauggaguccgugcggaacgggaccuacgacuacccccaguacagcgaggaggcccgccugaagcgggaggagaucuccggcgucaagcucgagucgaucgggaucuaccagauccuguccaucuacagcacgguggcguccucgcuggugcucgccaucaugauggccggccugucccuguggaugugcagcaacgggucccuccagugccgcaucugcaucuga

SEQ ID NO: 211 - RNA, 1707 nt, Artificial Sequence
  derived and/or modified CDS sequence (AUadapt) from InfluenzaA__AFM78567__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccaccaacgaccugugcuaccccggguccuucaacgacuacgaggagcugaagcaccuccugagccggaucaaccacuucgagaagauccagaucaucccgaaguccucgugguccgaccacgaggccagcuccggcgucagcuccgccugccccuaccugggcucgcccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucucgaucggcaccuccacccugaaccagcgccucgugcccaagaucgccacgcggagcaaggugaacgggcagagcggccgcauggaguucuucuggaccauccugaagcccaacgacgccaucaacuucgaguccaacgggaacuucaucgcgccggaguacgccuacaagaucgucaagaagggcgacucggccaucaugaaguccgagcuggaguacggcaacugcaacaccaagugccagacccccaugggggccaucaacagcuccaugcccuuccacaacauccacccccucacgaucggcgagugcccgaaguacgugaaguccaaccggcuggugcuggccaccgggcuccgcaacucgccccagcgggagagccgccggaagaagcgcggccuguucggcgcgaucgccggguucaucgagggcggguggcagggcauggucgacgggugguacggcuaccaccacuccaacgagcagggcucgggguacgccgccgacaaggaguccacccagaaggccaucgacggcgugaccaacaaggugaacagcaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucucgggggucaagcuggaguccaucggcacguaccagauccucagcaucuacuccaccguggccucgagccuggcgcuggccaucaugauggccgggcucucccuguggaugugcagcaacggcucccugcagugccgcaucugcaucuga

SEQ ID NO: 212 - RNA, 1707 nt, Artificial Sequence
  derived and/or modified CDS sequence (AUadapt) from InfluenzaA__ACR48872__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccucguccggcgucagcuccgccugccccuaccugggcagccccuccuucuuccgcaacgugguguggcucaucaagaagaacucgacguaccccaccaucaagaaguccuacaacaacaccaaccaggaggaccugcugguccucugggggauccaccacccgaacgacgcggccgagcagaccaugcuguaccagaaccccacgaccuacaucagcaucggcaccuccacccugaaccagcggcucgugcccaagaucgccacgcgcucgaaggugaacgggcagagcggccggauggaguucuucuggaccauccugaagcccaacgacgccaucaacuucgaguccaacgggaacuucaucgcgccggaguacgccuacaagaucgucaagaagggcgacagcgccaucaugaaguccgagcuggaguacggcaacugcaacaccaagugccagacccccaugggggccaucaacucguccaugcccuuccacaacauccacccccucacgaucggcgagugcccgaaguacgugaaguccaaccgccuggugcuggccaccgggcuccggaacagcccccagcgcgagagccggcgcaagaagcggggccuguucggcgcgaucgccggguucaucgagggcggguggcagggcauggucgacgggugguacggcuaccaccacuccaacgagcagggcucgggguacgccgccgacaaggaguccacccagaaggccaucgacggcgugaccaacaaggugaacagcaucaucgacaagaugaacacgcaguucgaggcggucgggcgcgaguucaacaaccuggagcggcgcaucgagaaccucaacaagaagauggaggacggcuuccuggacguguggaccuacaacgccgagcugcucgugcugauggagaacgagcggacccuggacuuccacgacuccaacgucaagaaccucuacgacaaggugcgccugcagcugcgggacaacgccaaggagcucgggaacggcugcuucgaguucuaccacaagugcgacaacgagugcauggagucgauccgcaacggcaccuacaacuacccccaguacuccgaggaggcccggcugaagcgcgaggagaucagcggggucaagcuggaguccaucggcacguaccagauccucagcaucuacuccaccguggccucgagccuggcgcuggccaucaugauggccgggcucucccuguggaugugcagcaacggcucccugcagugccggaucugcaucuga

SEQ ID NO: 213 - RNA, 1707 nt, Artificial Sequence; identical to SEQ ID NO: 211
  derived and/or modified CDS sequence (AUadapt) from InfluenzaA__ABW06108__HA

SEQ ID NO: 214 - RNA, 1707 nt, Artificial Sequence
  derived and/or modified CDS sequence (AUadapt) from InfluenzaA__EPI341633__HA
auggagaagaucacccugcuccugucgaucgugucccuggucaagagcgaccagaucugcaucggcuaccacgccaacaacuccaccgagcaggucgacacgaucauggagaagaacgugaccgugacccacgcccaggacauccucgagaagacccacaacgggaagcugugcgaccuggacggcgugaagccccucauccugaaggacugcucgguggcgggguggcugcucggcaacccgaugugcgacgaguucaucaacguccccgagugguccuacaucguggagaaggccaaccccacgaacgaccugugcuaccccgggagcuucaacgacuacgaggagcugaagcaccuccugucccgcaucaaccacuucgagaagauccagaucauccccaagagcuccuggucggaccacgaggccuccagcggcguguccucggccugccccuaccugggcucccccagcuucuuccggaacgucguguggcucaucaagaagaacuccaccuaccccaccaucaagaagaccuacaacaacacgaaccaggaggaccugcugauccucugggggauccaccacccgaacaacggcgccgagcagaccaugcuguaccagaaccccaccaccuacaucagcaucgggacguccacccugaaccagcgccucgugcccaagaucgcgacccggucgaaggucaacggccagagcgggcgcauggaguucuucuggaccauccugaagcccaacgacgccaucaacuucgaguccaacggcaacuucaucgccccggaguacgccuacaagaucgugaagaagggcgacucggcgaucaugaaguccgagcuggaguacgggaacugcaacacgaagugccagacccccaugggcgccaucaacagcuccaugcccuuccacaacauccaccccaucaccaucggggagugcccgaaguacgucaagagcaaccggcucgugcuggccaccggccugcgcaacuccccgcagcgggagucgcgccggaagaagcgcggccucuucggggccaucgccggcuucaucgagggcggguggcaggggaugguggacggcugguacggcuaccaccacuccaacgagcaggggagcggcuacgcggccgacaaggaguccacgcagaaggccaucgacggggugaccaacaaggucaacucgaucaucgacaagaugaacacccaguucgaggccgugggccgggaguucuccaaccuggagcgccggaucgagaaccugaacaagaagauggaggacggguuccucgacguguggaccuacaacgccgagcugcugguccucauggagaacgagcgcacgcuggacuuccacgacagcaacgugaagaaccuguacgacaaggugcggcuccagcugcgcgacaacgcgaaggagcugggcaacggcugcuucgaguucuaccacaagugcgacaacgagugcauggaguccauccggaacgggaccuacaacuacccccaguacagcgaggaggcccgccucaagcgggaggagaucuccggcgucaagcuggagucgaucgggaccuaccagauccuguccaucuacagcaccguggccucgucccucgcccuggccaucaugaucgcgggccugagccucuggaugugcuccaacgggagccugcagugccgcaucugcaucuga

SEQ ID NO: 215 - RNA, 1707 nt, Artificial Sequence
  derived and/or modified CDS sequence (AUadapt) from InfluenzaA__ABD95991__HA
auggagaagaucaugcugcuccuggccaucgugucgcuggucaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccucgggcguguccagcgccugcccguaccagggccgcuccucguucuuccggaacgucguguggcugaucaagaaggacaacgcguaccccaccaucaagcgcuccuacaacaacacgaaccaggaggaccugcuggugcucugggggauccaccaccccaacgacgccgccgagcagacccggcuguaccagaacccgaccaccuacaucucggucggcacguccacccugaaccagcgccucgugcccaagaucgccacccggagcaaggugaacgggcaguccggccgcauggaguucuucuggaccauccugaagcccaacgacgcgaucaacuucgagucgaacgggaacuucaucgcccccgagaacgccuacaagaucgucaagaagggcgacagcacgaucaugaaguccgagcuggaguacggcaacugcaacaccaagugccagaccccgaucggggccaucaacucguccaugcccuuccacaacauccacccccucaccaucggcgagugccccaaguacgucaagagcaaccggcuggugcuggccacggggcuccgcaacuccccgcagggcgagcggcgccggaagaagcgcggccuguucggggcgaucgccggcuucaucgagggcggguggcaggggaugguggacggcugguacggcuaccaccacucgaacgagcagggguccggcuacgccgccgacaaggagucgacccagaaggccaucgacggggugaccaacaaggugaacuccaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccaccggugcgacaacgagugcauggaguccguccgcaacgggaccuacgacuacccccaguacucggaggaggcccgccugaagcgggaggagaucuccggcgugaagcuggagagcaucgggaccuaccagauccucuccaucuacucgacgguggccuccagccuggcgcuggccaucauggucgccggccucucccuguggaugugcucgaacgggagccugcagugccgcaucugcaucuga

SEQ ID NO: 216 - RNA, 1707 nt, Artificial Sequence
  derived and/or modified CDS sequence (AUadapt) from InfluenzaA__AGN69453__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggucguacaucguggagaagaucaaccccgccaacgaccugugcuaccccgggaacuucaacgacuacgaggagcucaagcaccuccugucccggaucaaccacuucgagaagauccagaucauccccaagagcuccuggucggaccacgaggccuccgccggcgucagcuccgcgugcccguaccagggcaugucguccuucuuccgcaacgugguguggcugaucaagaaggacaacgccuaccccaccaucaagcggagcuacaacaacacgaaccaggaggaccugcugguccucugggggauccaccaccccaacgacgccgccgagcagaccaagcuguaccagaacuccaccaccuacaucucggugggcacguccacccugaaccagcgccucgugccgaagaucgcgacccggagcaaggucaacgggcaguccggccgcaucgaguucuucuggaccauccugaagcccaacgacacgaucaacuucgagucgaacgggaacuucaucgcccccgagaacgccuacaagaucgugaagaagggcgacagcaccaucaugaaguccgagcuggaguacggcaacugcaacaccaagugccagacccccaucggggccaucaacucguccaugccguuccacaacauccacccccucacgaucggcgagugccccaaguacgucaagagcucccggcuggugcuggccaccgggcuccgcaacucgccccagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacucgaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccggcugaagcgcgaggagaucucgggcgugaagcuggaguccaucgggacguaccagauccucagcaucuacuccaccgucgccucgucccuggcgcuggccaucaugguggccggccucagccuguggaugugcagcaacgggucccugcagugccgcaucugcaucuga

SEQ ID NO: 217 - RNA, 1707 nt, Artificial Sequence
  derived and/or modified CDS sequence (AUadapt) from InfluenzaA__AGN69452__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccgccggcgucucguccgcgugcccguaccagggccgcagcuccuucuuccggaacgugguguggcugaucaagaaggacaacgccuaccccaccaucaagcgcucguacaacaacacgaaccaggaggaccugcugguccucugggggauccaccaccccaacgacgccgccgagcagacccggcuguaccagaacuccaccaccuacaucagcgugggcacguccacccugaaccagcgccucgugccgaagaucgcgacccggucgaaggucaacgggcaguccggccgcaucgaguucuucuggaccauccugaagcccaacgacacgaucaacuucgagagcaacgggaacuucaucgcccccgagaacgccuacaagaucgugaagaagggcgacucgaccaucaugaaguccgagcuggaguacggcaacugcaacaccaagugccagacccccaucggggccaucaacagcuccaugccguuccacaacauccacccccucacgaucggcgagugccccaaguacgucaagucgucccggcuggugcuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggucgggcuacgccgccgacaaggaguccacccagaaggccaucgacggggugaccaacaaggucaacagcaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagucggugcgcaacgggaccuacgacuacccgcaguacuccgaggaggcccgccugaagcgggaggagaucagcggcgugaagcuggaguccaucgggacguaccagauccucucgaucuacuccaccgucgccagcucccuggcgcuggccaucaugguggccggccucucgcuguggaugugcagcaacgggucccugcagugccgcaucugcaucuga

SEQ ID NO: 218 - RNA, 1707 nt, Artificial Sequence
  derived and/or modified CDS sequence (AUadapt) from InfluenzaA__ABD73284__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccgccggcgucucguccgcgugcccguaccagggccgcagcuccuucuuccggaacgugguguggcugaucaagaaggacaacgccuaccccaccaucaagcgcucguacaacaacacgaaccaggaggaccugcugguccucugggggauccaccaccccaacgacgccgccgagcagacccggcuguaccagaacccgaccaccuacaucuccgugggcacgucgacccugaaccagcgccucgugcccaagaucgcgacccgguccaaggucaacgggcagagcggccgcauggaguucuucuggaccauccugaagcccaacgacgccaucaacuucgaguccaacgggaacuucaucgcccccgagaacgccuacaagaucgugaagaagggcgacucgacgaucaugaaguccgagcuggaguacggcaacugcaacaccaagugccagaccccgaucggggccaucaacagcucgaugcccuuccacaacauccacccccucaccaucggcgagugccccaaguacgugaaguccagccggcugguccuggcgacggggcuccgcaacuccccgcagggcgagcggcgccggaagaagcgcggccuguucggggccaucgccggcuucaucgagggcggguggcaggggaugguggacggcugguacggcuaccaccacucgaacgagcagggguccggcuacgccgccgacaaggagucgacccagaaggcgaucgacggggugaccaacaaggucaacuccaucaucgacaagaugaacacccaguucgaggccgugggccgggaguucaacaaccuggagcgccggaucgagaaccucaacaagaagauggaggacggguuccuggacguguggacguacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacucggaggaggcccgccugaagcgggaggagaucuccggcgugaagcuggagagcaucgggaccuaccagauccucuccaucuacucgacggucgcguccagccuggcccuggccaucaugguggccggccucucccuguggaugugcucgaacgggagccugcagugccgcaucugcaucuga

SEQ ID NO: 219 - RNA, 1695 nt, Artificial Sequence
  derived and/or modified CDS sequence (AUadapt) from InfluenzaA__ABF93440__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccucgggcgucuccagcgccugcccguaccagggccgcuccucguucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccagaacccgaccaccuacaucagcgugggcacguccacccugaaccagcgccucgugcccaagaucgccacccggucgaaggucaacgggcaguccggccgcauggaguucuucuggaccauccugaagcccaacgacgcgaucaacuucgagagcaacgggaacuucaucgcccccgagaacgccuacaagaucgugaagaagggcgacucgacgaucaugaaguccgagcuggaguacggcaacugcaacaccaagugccagaccccgaucggggccaucaacagcuccaugcccuuccacaacauccacccccucaccaucggcgagugccccaaguacgucaagucgaaccggcuggugcuggccacggggcuccgcaacuccccgcagaucgagacccggggccuguucggcgcgaucgccggguucaucgagggcggguggcagggcaugguggacgggugguacggcuaccaccacagcaacgagcagggcuccggguacgccgccgacaaggagucgacccagaaggccaucgacggcgugaccaacaaggucaacuccaucaucgacaagaugaacacgcaguucgaggcgguggggcgcgaguucaacaaccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccaccgcugcgacaacgagugcauggaguccgugcggaacggcaccuacgacuacccccaguacucggaggaggcccgccugaagcgggaggagaucuccggggugaagcuggagagcaucggcacguaccagauccucuccaucuacucgaccgucgccuccagccuggcgcuggccaucaugguggccgggcucucccuguggaugugcucgaacggcagccugcagugccgcaucugcaucuga

SEQ ID NO: 220 - RNA, 1701 nt, Artificial Sequence
  derived and/or modified CDS sequence (AUadapt) from InfluenzaA__AKC45369__HA
auggagaagaucgugcugcuccuggccgucgugucgcuggugaaguccgaccagaucugcaucggcuaccacgccaacaacucgaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagucguccuggccgaaccacacgucguccggcgugagcgccgcgugccccuaccagggcacccccuccuucuuccgcaacguggucuggcugaccaagaagaacgacgccuacccgaccaucaagaugucguacaacaacacgaaccgggaggaccugcucauccugugggggauccaccacuccaacaacgccgccgagcagaccaaccuguacaagaaccccaccaccuacgugucggugggcacguccacccucaaccagcgccugguccccaagaucgcgacccggagccaggugaacgggcagcgcggccggauggacuucuucuggaccauccugaagcccaacgacgccauccacuucgaguccaacgggaacuucaucgccccggaguacgccuacaagaucgugaagaagggcgacucgacgaucaugaaguccgagauggaguacggccacugcaacaccaagugccagacccccaucggggccaucaacucgagcaugcccuuccacaacauccacccccucaccaucggcgagugcccgaaguacgucaaguccaacaagcuggugcuggcgacggggcuccgcaacucgccccugcgggagcgccggcgcaagcggggccuguucggcgccaucgccggguucaucgagggcggguggcagggcaugguggacgggugguacggcuaccaccacuccaacgagcagggcucgggguacgccgccgaccgcgaguccacccagaaggcgaucgacggcgucaccaacaaggugaacagcaucaucgacaagaugaacacccaguucgaggccguggggcgggaguucaacaaccucgagcgccggaucgagaaccugaacaagaagauggaggacggcuuccuggacgucuggacguacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcgacaacgagugcauggagucggugcgcaacggcaccuacgacuacccccaguacuccgaggaggcccggcugaagcgcgaggagaucucgggggucaagcucgaguccaucggcaccuaccagauccugagcaucuacuccacgguggcgucgucccuggcccucgccaucaucguggccgggcugucgcuguggaugugcuccaacggcagccuccagugccggaucugcaucuga

SEQ ID NO: 221 - RNA, 1704 nt, Artificial Sequence
  derived and/or modified CDS sequence (AUadapt) from InfluenzaA__AJS18479__HA
auggagaagaucgugcugcuccuggccgucgugucgcuggugaaguccgaccagaucugcaucggcuaccacgccaacaacucgaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagucguccuggccgaaccacgagacgucgcugggcguguccgccgcgugccccuaccagggcaugcccagcuucuuccgcaacguggucuggcugaccaagaagaacgacaccuacccgaccaucaagauguccuacaacaacacgaaccgggaggaccuccugauccugugggggauccaccacucgaacaacgccgccgagcagaccaaccucuacaagaaccccaccaccuacguguccgugggcacggccacccugaaccagcgccugguccccaagaucgcgacccggucgcaggugaacgggcagcgcggccggauggacuucuucuggaccauccucaagcccaacgacgccauccacuucgaguccaacgggaacuucaucgccccggaguacgccuacaagaucgugaagaagggcgacagcacgaucaugaaguccgagauggaguacggccacugcaacaccaagugccagacccccaucggggccaucaacucguccaugcccuuccacaacauccacccccugaccaucggcgagugcccgaaguacgucaagucgaacaagcuggugcucgcgacggggcugcgcaacagcccccugcgggagcgccggcgcaagcggggccucuucggcgccaucgccggguucaucgagggcggguggcagggcaugguggacgggugguacggcuaccaccacuccaacgagcagggcucgggguacgccgccgaccgcgaguccacccagaaggcgaucgacggcgucaccaacaaggugaacucgaucaucgacaagaugaacacccaguucgaggccguggggcgggaguucaacaaccuggagcgccggaucgagaaccugaacaagaagauggaggacggcuuccucgacgucuggacguacaacgccgagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucucgggggucaagcuggaguccaucggcaccuaccagauccugucgaucuacuccacgguggcgagcucccucgcccuggccaucaucguggccgggcugucgcucuggaugugcuccaacggcagccugcagugccggaucugcaucuga

SEQ ID NO: 222 - RNA, 1704 nt, Artificial Sequence
  derived and/or modified CDS sequence (AUadapt) from InfluenzaA__EPI691378__HA
auggagaagaucgugcugcuccuggccgucgugucgcuggugaaguccgaccagaucugcaucggcuaccacgccaacaacucgaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagucguccuggccgaaccacgagacgagccugggcguguccgccgcgugccccuaccagggcgugcccucguucuuccgcaacgucguguggcugaccaagaagaacgacgccuacccgaccaucaagauguccuacaacaacaccaaccgggaggaccuccugauccugugggggauccaccacucgaacaacgccgccgagcagacgaaccucuacaagaaccccaccaccuacguguccgucggcaccagcacgcugaaccagcgccuggugcccaagaucgcgacccggucccaggugaacgggcagcgcggccggauggacuucuucuggaccauccucaagcccaacgacgccauccacuucgagucgaacgggaacuucaucgccccggaguacgccuacaagaucgucaagaagggcgacuccaccaucaugaaguccgagauggaguacggccacugcaacacgaagugccagacccccaucggggccaucaacuccagcaugcccuuccacaacauccacccccugaccaucggcgagugcccgaaguacgucaagucgaacaagcuggugcucgcgaccgggcugcgcaacucgccccugcgggagcgccggcgcaagcggggccucuucggcgccaucgccggguucaucgagggcggguggcagggcaugguggacgggugguacggcuaccaccacagcaacgagcagggcuccggguacgccgccgaccgcgagucgacgcagaaggcgaucgacggcgugaccaacaaggugaacuccaucaucgacaagaugaacacccaguucgaggccgucgggcgggaguucaacaaccuggagcgccggaucgagaaccugaacaagaagauggaggacggcuuccucgacguguggaccuacaacgccgagcugcugguccucauggagaacgagcgcacgcuggacuuccacgacagcaacgugaagaaccuguacgacaaggugcggcuccagcugcgcgacaacgccaaggagcuggggaacggcugcuucgaguucuaccacaagugcgacaacgagugcauggaguccguccgcaacggcaccuacgacuacccccaguacucggaggaggcccggcucaagcgcgaggagaucuccggggugaagcuggagucgaucggcaccuaccagauccuguccaucuacagcaccguggcguccucgcucgcccuggccaucaucgucgccgggcugucccucuggaugugcagcaacggcucccugcagugccggaucugcaucuga

SEQ ID NO: 223 - RNA, 1704 nt, Artificial Sequence
  derived and/or modified CDS sequence (AUadapt) from InfluenzaA__EPI533583__HA
auggagaagaucgugcugcuccuggccaucgucucgcuggugaagggcgaccagaucugcaucggguaccacgccaacaacuccaccgagcaggucgacaccaucauggagaagaacgugacggugacccacgcgcaggacauccucgagaagacccacaacggcaagcugugcgaccugaacggggugaagccccucauccugaaggacugcucggucgccggcuggcugcucgggaacccgaugugcgacgaguucauccgcgugcccgagugguccuacaucguggagcgggccaaccccgccaacgaccugugcuaccccggcaaccugaacgacuacgaggagcucaagcaccuccugagccgcaucaaccacuucgagaagauccugaucaucccgaaguccucguggaccaaccacgagacgucccugggcgucagcgccgcgugccccuaccaggggacccccuccuucuuccggaacgugguguggcugaucaagaagaacgacgccuaccccaccaucaagaucucguacaacaacaccaaccaggaggaccuccugauccuguggggcguccaccacuccaacaacgccgccgagcagacgaaccucuacaagaacccgaccaccuacaucucgguggggaccuccacgcugaaccagcgccuggugcccaagaucgcgacccggagccaggucaacggccagcgcgggcggauggacuucuucuggaccauccucaagcccaacgacgccauccacuucgaguccaacggcaacuucaucgcccccgaguacgccuacaagaucgugaagaagggcgacucgaccaucaugaaguccgagauggaguacgggcacugcaacacgaagugccagaccccgaucggcgccaucaacagcuccaugcccuuccacaacauccacccccugaccaucggggagugccccaaguacgucaagucgaacaagcuggugcucgcgaccggccugcgcaacucgccgcugcgggagaagcgccggaagcgcggccucuucggggccaucgccggcuucaucgagggcggguggcaggggaugguggacggcugguacggcuaccaccacuccaacgagcaggggagcggcuacgccgccgacaaggaguccacgcagaaggcgaucgacggggugaccaacaaggucaacucgaucaucgacaagaugaacacccaguucgaggccgugggccgggaguucaacaaccuggagcgccggaucgagaaccugaacaagaagauggaggacggguuccucgacguguggaccuacaacgccgagcugcugguccucauggagaacgagcgcacgcuggacuuccacgacuccaacgugaagaaccuguacgacaagguccggcuccagcugcgcgacaacgccaaggagcugggcaacggcugcuucgaguucuaccacaagugcgacaacaagugcauggagagcgugcggaacgggaccuacgacuacccccaguacuccgaggaggcccgccucaagcgggaggagaucucgggcgugaagcuggaguccaucgggaccuaccagauccugucgaucuacuccaccgucgcgagcucccucgcccuggccaucaucguggccggccugucgcucuggaugugcuccaacgggagccugcagugccgcaucugcaucuga

SEQ ID NO: 224 - RNA, 1701 nt, Artificial Sequence
  derived and/or modified CDS sequence (AUadapt) from InfluenzaA__AKS48023__HA
auggagaagauggugcugcuccuggccgucgugucgcuggugaaguccgaccagaucugcaucggcuaccacgccaacaacucgaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagucguccuggccgaaccacacgucguccggcgugagcgccgcgugccccuaccagggcaugcccuccuucuuccgcaacguggucuggcugaccaagaagaacgacgccuacccgaccaucaagaugucguacaacaacaccuaccgggaggaccugcucauccugugggggauccaccacuccaacaacgccgccgagcagacgaaccuguacaagaaccccaccaccuacgugagcgugggcaccuccacgcucaaccagcgccuggagcccaagaucgcgacccggucgcaggucaacgggcagcgcggccggauggacuucuucuggaccauccugaagcccaacgacgccauccacuucgaguccaacgggaacuucaucgccccggaguacgccuacaagaucgugaagaagggcgacucgaccaucaugaaguccgagauggaguacggccacugcaacacgaagugccagacccccaucggggccaucaacagcucgaugcccuuccacaacauccacccccucaccaucggcgagugcccgaaguacgugaaguccaacaagcugguccuggcgaccgggcuccgcaacucgccccugcgggagcgccggcgcaagcggggccuguucggcgccaucgccggguucaucgagggcggguggcagggcaugguggacgggugguacggcuaccaccacuccaacgagcagggcagcggguacgccgccgaccgcgaguccacgcagaaggcgaucgacggcgugaccaacaaggucaacucgaucaucgacaagaugaacacccaguucgaggccguggggcgggaguucaacaaccucgagcgccggaucgagaaccugaacaagaagauggaggacggcuuccuggacguguggaccuacaacgccgagcuccugguccugauggagaacgagcgcacgcucgacuuccacgacuccaacgugaagaaccuguacgacaagguccggcugcagcuccgcgacaacgccaaggagcuggggaacggcugcuucgaguucuaccacaagugcgacaacgagugcauggagagcgugcgcaacggcaccuacgacuacccccaguacuccgaggaggcccggcugaagcgcgaggagaucucgggggugaagcucgaguccaucggcaccuaccagauccugucgaucuacuccaccgucgcgagcucccuggcccucgccaucaucguggccgggcugucgcuguggaugugcuccaacggcagccuccagugccggaucugcaucuga

SEQ ID NO: 225 - RNA, 1701 nt, Artificial Sequence
  derived and/or modified CDS sequence (AUadapt) from InfluenzaA__EPI587621__HA
auggagaagauggugcugcuccuggccgccgucucgcuggugaaguccgaccagaucugcaucggcuaccacgcgaacaacucgaccgagcaggucgacaccaucauggagaagaacgugacggugacccacgcccaggacauccucgagaagacccacaacgggcgccugugcgaccugaacggcgugaagccccucauccugaaggacugcuccgucgccggguggcugcucggcaacccgaugugcgacgaguucauccgggugcccgaguggagcuacaucguggagcgcgccaaccccgccaacgaccugugcuaccccgggaaccugaacgacuacgaggagcucaagcaccuccugucccggaucaaccacuucgagaagacccugaucauccccaagucguccuggccgaaccacacgucguccggcgucagcgcggccugccccuaccagggcaugcccuccuucuuccgcaacgugguguggcugaccaagaagaacgacgccuacccgaccaucaagaugucguacaacaacaccuaccgggaggaccugcucauccugugggggauccaccacuccaacaacgccgcggagcagacgaaccuguacaagaaccccaccaccuacgucucggugggcaccuccacgcucaaccagcgccuggagcccaagaucgccacccggagccaggugaacgggcagcgcggccggauggacuucuucuggaccauccugaagcccaacgacgccauccacuucgaguccaacgggaacuucaucgccccggaguacgccuacaagaucgucaagaagggcgacucgaccaucaugaaguccgagauggaguacggccacugcaacacgaagugccagacccccaucggggcgaucaacucgagcaugcccuuccacaacauccacccccucaccaucggcgagugcccgaaguacgugaaguccaacaagcuggugcuggccaccgggcuccgcaacucgccccugcgggagcgccggcgcaagcggggccuguucggcgccaucgccggguucaucgagggcggguggcagggcauggucgacgggugguacggcuaccaccacuccaacgagcagggcucgggguacgccgcggaccgcgaguccacgcagaaggccaucgacggcgugaccaacaaggugaacagcaucaucgacaagaugaacacccaguucgaggccgucgggcgggaguucaacaaccucgagcgccggaucgagaaccugaacaagaagauggaggacggcuuccuggacguguggaccuacaacgccgagcuccuggugcugauggagaacgagcgcacgcucgacuuccacgacuccaacgucaagaaccuguacgacaaggugcggcugcagcuccgcgacaacgccaaggagcuggggaacggcugcuucgaguucuaccacaagugcgacaacgagugcauggagucgguccgcaacggcaccuacgacuacccccaguacuccgaggaggcgcggcugaagcgcgaggagaucucgggggugaagcucgaguccaucggcaccuaccagauccugagcaucuacuccaccguggccucgucccuggcccucgccaucaucgucgccgggcugucgcuguggaugugcuccaacggcagccuccagugccggaucugcaucuga

SEQ ID NO: 226 - RNA, 1704 nt, Artificial Sequence
  derived and/or modified CDS sequence (AUadapt) from InfluenzaA__AJE30333__HA
auggagaagaucgugcugcuccuggccgucaucucgcuggugaaguccgaccagaucugcaucggcuaccacgccaacaacagcaccaagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggucguacaucguggagcgggccaaccccgccaacgaccugugcuaccccgggacccugaacgacuacgaggagcucaagcaccuccugucccgcaucaaccacuucgagaagacgcugaucaucccgcggagcuccuggcccaaccacgagaccucgcugggcgucuccgccgcgugccccuaccagggcgccagcuccuucuuccgcaacgugguguggcugaucaagaagaacgacgccuaccccaccaucaagaucucguacaacaacaccaaccgggaggaccuccugauccugugggggauccaccacuccaacaacgccgcggagcagacgaaccucuacaagaacccggacaccuacgucagcgugggcaccuccacccugaaccagcgccuggugcccaagaucgccacgcggucgcaggucaacgggcaguccggccgcauggacuucuucuggaccauccucaagcccaacgacgccauccacuucgagagcaacgggaacuucaucgcccccgaguacgccuacaagaucgugaagaagggcgacuccaccaucaugaaguccgagauggaguacggccacugcaacaccaagugccagacgccgaucggggcgaucaacucgagcaugcccuuccacaacauccacccccugaccaucggcgagugccccaaguacgucaagucgaacaagcuggugcucgccaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgcggacaaggagucgacccagaaggccaucgacggcgugacgaacaaggucaacuccaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcacguacgacuaccccaaguacucggaggaggcgauccucaagcgcgaggagaucuccggggugaagcuggagagcaucggcaccuaccagauccuguccaucuacucgaccgucgccuccagccucgcccuggccaucaucguggccgggcugucccucuggaugugcagcaacggcucccugcagugccgcaucugcaucuga

SEQ ID NO: 227 - RNA, 1704 nt, Artificial Sequence
  derived and/or modified CDS sequence (AUadapt) from InfluenzaA__EPI459855__HA
augaucgccaucguggucaucgccauccuggcgucggccggcaaguccgacaagaucugcaucggguaccacgccaacaacagcaccacccagguggacacgcuccuggagaagaacgugaccgucacccacuccguggagcugcucgagaaccagaaggagaagcgcuucugcaagaucaugaacaaggcgccccuggaccugaaggacugcaccaucgagggcuggauccucgggaacccgaagugcgaccugcugcucggcgaccagucgugguccuacaucguggagcggcccaacgcccagaacgggaucugcuaccccggcguccugaacgagcuggaggagcucaaggccuucaucggcagcggggagcgcguggagcgguucgagauguuccccaaguccacgugggccggcguggacaccucgcgcggggucaccaacgccugcccguccuacaccaucgacagcuccuucuaccggaaccugguguggaucgugaagacggacucggccaccuaccccgucaucaagggcaccuacaacaacaccgggacgcagcccauccuguacuucuggggcgugcaccacccccucgacaccaccgugcaggacaaccuguacggcuccggggacaaguacguccgcaugggcaccgagagcaugaacuucgcgaaguccccggagaucgccgcccggcccgccgugaacgggcagcgcucgcggaucgacuacuacugguccgugcugcgccccggcgagacgcucaacgucgagagcaacggcaaccugaucgcccccugguacgcguacaaguucguguccaccaacaagaagggggccguguucaagagcgaccugccgaucgagaacugcgacgcgaccugccagaccaucacgggcguccuccggaccaacaagaccuuccagaacgugucgccccuguggaucggggagugccccaaguacgugaaguccgagagccugcgccucgccaccggccugcggaacgucccccagaucgccacgcgcgggaucuucggcgccaucgccggcuucaucgagggcggguggaccgggaugaucgacggcugguacggguaccaccacgagaacucccagggcucgggcuacgccgccgaccgggaguccacccagaaggccaucgacgggaucaccaacaaggugaacagcaucaucaacaagaugaacacgcaguucgaggcggucgaccacgaguucuccaaccuggagcgccggaucggcaaccucaacaagcgcauggaggacggguuccuggacguguggaccuacaacgccgagcugcucgugcugcuggagaacgagcggacccucgaccugcacgacgccaacgucaagaaccuguacgagaaggucaagucgcagcuccgcgacaacgccaacgaccugggcaacgggugcuucgaguucuggcacaagugcgacaacgagugcauggaguccgugaagaacggcaccuacgacuacccgaaguaccagaaggagagcaagcugaaccggcagggcaucgaguccgugaagcucgagaaccuggggguguaccagauccuggccaucuacucgacgguguccagcucccucguccuggugggccugaucauggcgaucgggcucuggaugugcagcaacggcuccaugcagugccgcaucugcaucuga

SEQ ID NO: 228 - RNA, 1704 nt, Artificial Sequence; identical to SEQ ID NO: 227
  derived and/or modified CDS sequence (AUadapt) from InfluenzaA__EPI459855/m1__HA

SEQ ID NO: 229 - RNA, 1692 nt, Artificial Sequence
  derived and/or modified CDS sequence (AUadapt) from InfluenzaA__ACZ36872__HA
augaauacccagauccugguguucgcccucgucgccgugauccacaccaacgcggacaagaucugccugggccaccacgccgugaguaacgggacgaaggucaacacccugaccgagcgcggcguggagguggucaacgccaccgagacgguggagcggaccaacauccccaagaucugcuccaaggggaagcgcaccguggaccucggccagugcgggcugcugggcaccaucacgggcccgccccagugcgaucaguuccucgaguucagcgccgaccugaucaucgagcggcgcgacgggaacgacgucugcuaucccggcaaguucgugaacggggaggcccugcggcagauccuccgcaaguccggcgggaucaacaaggagaccaugggcuucaccuacagcggcauccggaccaacgggacgaccuccgcgugccgccggaguggcuccagcuucuacgccgagaugaaguggcugcuguccgacaccgacaacgccgccuucccccagaugaccaagagcuauaagaacacgcgccgggagccggcgcucaucgugugggggauccaccacuccggcucgaccaccgagcagaccaagcuguacggcuccgggaacaagcuggucacggugggcagcuccaaguaccagcagaguuucgugcccucccccgggacccgcccccaggucaacggccagagcgggcggaucgacuuccacuggcucauccuggacuccaacgauaccgugaccuucagcuucaacggcgccuucaucgccccggaccgcgccagcuuccugaagggcaaguccauggggauccagagugacgugcaggucgacgccaacugcgagggcgagugcuaccacuccgggggcacgaucaccaguucccuccccuuccagaacaucaacagccgggcgguggggaagugcccccgcuacgugaagcaggagucccugcugcucgccaccggcaugaagaacguccccgagcugccgaagaagcggcgcaagcggggccuguucggggccaucgccggcuuuaucgagaacgggugggagggccucguggacgggugguacggcuuccgccaccagaacgcccagggcgaggggaccgcggccgacuacaagaguacgcaguccgccaucgaccagaucaccggcaagcugaaccggcugaucgagaagaccaaccagcaguucgagcucaucgacaacgaguucaccgagguggagaagcagaucgggaacgucaucaauuggacgcgcgacagcaucaccgaggugugguccuacaacgccgagcugcuggucgccauggagaaccagcacaccaucgaccucgcggacagugagaugaacaagcuguacgagcgcgugcggaagcagcugcgcgagaacgccgaggaggacggcaccggcugcuucgagaucuuccacaagugugacgacgacugcauggccuccauccggaacaacacguacgaccauagcaaguaccgcgaggaggccaugcagaaccggauccagaucgaccccgugaagcucuccgggggcuacaaggacgucauccugugguucagcuuuggggccuccugcuuccugcuccuggcgaucgccaugggccugguguucaucugcgugaagaacgggaacaugcgcugcaccaucugcaucuga

SEQ ID NO: 230 - RNA, 1692 nt, Artificial Sequence
  derived and/or modified CDS sequence (AUadapt) from InfluenzaA__AGB51388__HA
augaauacccagauccugguguucgcccucgucgccgugauccacaccaacgcggacaagaucugccugggccaccacgccgugucgaaugggacgaaggucaacacccugaccgagcgcggcguggagguggucaacgccaccgagacgguggagcggaccaacauccccaagaucugcuccaaggggaagcgcaccguggaccucggccagugcgggcugcugggcaccaucacgggcccgccccagugcgaccaguuccucgaguuuagcgccgaccugaucaucgagcggcgcgacgggaacgacgucugcuaccccggcaaguucgugaauggggaggcccugcggcagauccuccgcaaguccggcgggaucaacaaggagaccaugggcuucaccuacagcggcauccggaccaacgggacgaccuccgcgugccgccggucgggcuccagcuucuaugccgagaugaaguggcugcuguccgacaccgacaacgccgccuucccccagaugaccaagagcuacaagaacacgcgccgggagccggcgcucaucgugugggggauccaccauuccggcucgaccaccgagcagaccaagcuguacggcuccgggaacaagcuggucacggugggcagcuccaaguaccagcagagcuucgugcccaaccccgagacccgcccccaggucaacgggcaguccggccggaucgauuuccacuggcucauccuggacagcaacgacaccgugaccuucuccuucaauggggccuucaucgccccggaccgcgccucguuccugaagggcaagagcaugggcauccaguccgacgugcaggucgacgccaacugcgagggggaguguuaccacagcggcgggacgaucaccuccucgcuccccuuccagaacaucaacucccgggcggugggcaagugcccccgcuaugugaagcaggagagccugcugcucgccaccgggaugaagaacguccccgagcugccgaagaagcggcgcaagcggggccuguucggcgccaucgccggguucaucgagaacggcugggaggggcucguggacggcugguacggguuccgccaccagaaugcccagggcgagggcaccgcggccgacuacaaguccacgcagagcgccaucgaccagaucaccgggaagcugaaccggcugaucgagaagaccaaccagcaguucgagcucaucgacaaugaguucaccgagguggagaagcagacgggcaacgucaucaacuggacccgcgacuccaucaccgagguguggucguacaacgccgagcugcuggucgccauggagaaccagcacaccaucgaucucgcggacuccgagaugaacaagcuguacgagcgcgugcggaagcagcugcgcgagaacgccgaggaggacgggacgggcugcuucgagaucuuccauaagugcgacgacgacugcauggccagcauccggaacaacaccuacgaucacuccaaguaccgcgaggaggccaugcagaaccggauccagaucgaccccgugaagcucagcggcggguacaaggacgucauccugugguucuccuuuggcgccagcugcuuccugcuccuggcgaucgccauggggcugguguucaucugcgugaagaacggcaacaugcgcugcaccaucugcaucuga

SEQ ID NO: 231 - RNA, 1683 nt, Artificial Sequence; identical to SEQ ID NO: 86
  derived and/or modified CDS sequence (AUadapt) from InfluenzaA__EPI439507__HA

SEQ ID NO: 232 - RNA, 1704 nt, Artificial Sequence
  derived and/or modified CDS sequence (AUadapt) from InfluenzaA__EPI164216__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagucguccuggagcgaccacgaggccuccucgggcgucuccagcgcgugcccguaccagggcacccccuccuucuuccgcaacgugguguggcugaucaagaagaacaacacguaccccaccaucaagcggucguacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggucgaaggugaacgggcaguccggccgcauggacuucuucuggaccauccucaagcccaacgacgcgaucaacuucgagagcaacgggaacuucaucgcccccgaguacgccuacaagaucgucaagaagggcgacucggccaucgugaaguccgagguggaguacggcaacugcaacaccaagugccagaccccgaucggggccaucaacagcuccaugcccuuccacaacauccacccccugacgaucggcgagugccccaaguacgucaagucgaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagucgacccagaaggcgaucgacggcgucaccaacaaggugaacuccaucaucgacaagaugaacacgcaguucgaggccguggggcgggaguucaacaaccuggagcgccggaucgagaaccugaacaagaagauggaggacggcuuccucgacgucuggaccuacaacgccgagcugcuggugcucauggagaacgagcgcacccuggacuuccacgacagcaacgucaagaaccuguacgacaaggugcggcuccagcugcgcgacaacgccaaggagcuggggaacggcugcuucgaguucuaccacaagugcgacaacgagugcauggaguccgugcggaacggcaccuacgacuacccccaguacucggaggaggcccgccucaagcgggaggagaucuccggggucaagcuggagagcaucggcacguaccagauccuguccaucuacucgaccguggcguccagccucgcccuggccaucaugguggccgggcugucccucuggaugugcucgaacggcagccugcagugccgcaucugcaucuga

SEQ ID NO: 233 - RNA, 1683 nt, Artificial Sequence
  derived and/or modified CDS sequence (AUadapt) from InfluenzaA__EPI486492__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagugccgaccugaucaucgagcgccgggagggguccgacgugugcuaccccggcaaguucgugaacgaggaagcccugcgccagauccuccgggagagcgggggcaucgacaaggaggcgaugggguuuaccuacuccggcauccgcaccaacggcaccacgagcgccugccggcgcuccgggagcuccuucuacgccgagaugaaguggcugcugagcaacaccgauaacgccgcguucccgcagaugaccaaguccuacaagaacacccgcaagagccccgcccucaucgucuggggcauccaccacuccgugagcacggccgagcagaccaagcuguauggguccggcaacaagcuggugaccgucggcagcuccaacuaccagcagagcuucgugcccucccccggggcccggccccaggugaacggccucagcgggcggaucgacuuucacuggcugaugcugaaccccaacgacaccgucacguucagcuucaacggcgccuuuaucgcgcccgaccgcgccuccuuccuccggggcaaaagcauggggauccaguccggcguccagguggacgccaacugcgagggggacugcuaccauagcggcgggaccaucaucuccaaccugcccuuccagaacaucgacagccgcgccgugggcaagugcccgcgguacgugaagcagcgcucccugcuccuggccaccgggaugaagaaugugcccgagauccccaagggccggggccuguucggggcgaucgccggcuucaucgagaacgggugggagggccucaucgacgggugguacggcuuccgccaccagaacgcccagggcgaggggaccgccgccgacuauaagagcacgcaauccgcgaucgaccagaucaccggcaagcugaaccggcugaucgagaagaccaaccagcaguucgagcucaucgacaacgaguucaaugaggucgagaagcagaucgggaacgugaucaacuggacccgcgacagcaucacggaggugugguccuacaacgccgagcugcuggucgccauggagaaccagcacaccaucgaccucgccgauagcgagauggacaaacuguacgagcgcgugaagcggcagcugcgcgagaacgccgaggaggacggcaccggcugcuucgagaucuuccauaagugcgacgacgacugcauggcguccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgccaucgugauggggcuggucuucaucugcgugaagaacggcaacaugcgcugcacgaucugcaucuga

SEQ ID NO: 234 - RNA, 1683 nt, Artificial Sequence
  derived and/or modified CDS sequence (AUadapt) from InfluenzaA__EPI740738__HA
augaauacccaaauccugguguucgcccucaucgccaucauccccaccaacgcggacaagaucugccugggccaccacgccgucagcaacgggacgaaggugaacacccugaccgagcgcggcguggaggucgugaaugccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaucugaucaucgagcgccgggagggguccgacgugugcuaccccggcaaguucgugaacgaggaggcccugcgccagauccuccgggagagcgggggcaucgacaaggagaccaugggguucaccuacuccggcauccgcaccaauggcgucacgagcgcgugcaagcgguccgggagcuccuucuacgccgagaugaaguggcugcugagcaacaccgacaacgccgccuuuccccagaugaccaaguccuacaagaacacccgcaagagccccgcgaucaucguguggggcauccaccacuccgugagcacggccgaacagaccaagcucuacggguccggcaacaagcuggucaccgugggcagcuccaauuaccagcagagcuucgugcccucccccggggcccggccgcaggucaacggccugagcgggcgcaucgacuuccacuggcucauccugaaccccaaugacaccgugacguucagcuucaacggcgccuucaucgcccccgaccgggcguccuuccugcgcggcaagagcauggggauccaguccggcgugcaggucgaugccaacugcgagggggacugcuaccacagcggcgggaccaucaucuccaaccuccccuuccagaauaucgacagccgggccgugggcaagugcccgcgcuacgugaagcagcggucccugcugcucgccaccgggaugaagaacguccccgagauccccaagggccgcggccuguucggggccaucgcgggcuucaucgagaacgggugggagggccugaucgacgggugguauggcuuccggcaccagaacgcccagggcgaggggaccgccgccgacuacaagagcacgcaguccgccaucgaccagaucaccggcaagcucaaccgccugaucgcgaagaccaaccagcaauuugagcugaucgacaacgaguucaacgagguggagaagcagaucgggaacgugaucaacuggacccgggacagcaucacggaggucugguccuacaaugccgagcuccugaucgccauggagaaccagcacaccaucgaccuggccgacagcgagauggacaagcucuacgagcgcgugaagcgccagcugcgggagaacgccgaggaggacggcaccggcuguuucgagaucuuccacaagugcgacgacgacugcauggcguccauccgcaacaauaccuacgaccaccggaaguaccgcgaggaggccaugcagaaccggauccagaucgaccccgucaagcugagcuccggguacaaggacgugauccucugguuuagcuucggcgccuccugcuucauccugcuggccaucgugauggggcucgucuucaucugcgugaagaacggcaacaugcgcugcacgaucugcaucuga

SEQ ID NO: 235 - RNA, 1683 nt, Artificial Sequence
  derived and/or modified CDS sequence (AUadapt) from InfluenzaA__EPI730495__HA
augaauauccaaauccugguguucgcccucaucgccaucauccccaccgacgcggacaagaucugccugggccaccacgccgucagcaacgggaccaaggugaacacgcugaccgagcgcggcguggaggucgugaaugccaccgagaccguggagcggacgaacaucccgcgcaucugcuccaaggggaagcggaccgucgaccucggccaaugcgggcugcugggcaccaucaccggcccgccccagugcgaccaguuccucgaguucagcgccgaccugaucaucgagcgccgggagggguccgaugugugcuaccccggcaaguucgugaacgaggaggcccugcgccagauccuccgcaaaagcgggggcaucgacaaggaggcgaugggguucacguacuccggcauccggaccaacggcgccaccagcgccugucggcgcuccgggagcuccuucuacgccgagaugaaguggcugcugagcaacaccgacaacgcggccuucccgcagaugacgaaguccuacaagaauacccgcaagagccccgccaucaucgucuggggcauccaccacuccgugagcaccgccgagcaaaccaagcucuacggguccggcagcaagcuggugacggucggcuccagcaacuaccagcaguccuucgugcccagucccggggcccggccccaggugaacggccugagcgggcggaucgacuuccacuggcucauccugaaccccaacgacaccgucaccuucuccuucaauggcgcguucaucgcccccgaccgcgccagcuuccugcgggggaaguccaugggcauccagagcggcguccagguggacgccgacugcgagggggacugcuaucacuccggcgggaccaucaucagcaaccuccccuuccaaaacaucgacucccgcgccgugggcaagugcccgcgguacgugaagcagcgcagccugcugcucgcgacggggaugaagaaugugcccgagauccccaagggccggggccuguucggggccaucgccggcuucaucgagaacgggugggagggccugaucgacgggugguacggcuuccgccaccaaaacgcccagggcgaggggaccgccgcggacuacaaguccacccagagugccaucgaccagaucaccggcaagcucaaccggcugaucgagaagacgaaccagcaauucgagcugaucgacaacgaguucaucgaggucgagaagcagaucgggaacgugaucaacuggacccgcgacuccaucaccgagguguggaguuacaacgccgagcuccuggucgccauggagaaccaacacaccaucgaccuggccgacuccgagauggacaagcucuacgagcgcgugaagcggcagcugcgcgagaacgcggaggaggauggcacgggcugcuucgagaucuuccacaaaugcgacgacgacugcauggccagcauccggaauaacaccuacgaccacuccaaguaccgcgaggaggccaugcagaaccggauccagaucgaccccgucaagcugagcuccggguacaaggacgugauccucugguuuagcuucggcgccuccugcuucauccugccggcgaucgugauggggcuggucuucaugugcgugaagaacggcaacaugcgcugcaccaucugcaucuga

SEQ ID NO: 236 - RNA, 1683 nt, Artificial Sequence
  derived and/or modified CDS sequence (AUadapt) from InfluenzaA__EPI712926__HA
augaauacccaaauccugguguucgcccucaucgccaucauccccaccaacgcggacaagaucugccugggccaccacgccgucagcaacgggacgaaggugaacacccugaccgagcgcggcguggaggucgugaaugccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaucugaucaucgagcgccgggagggguccgacgugugcuaccccggcaaguucgugaacgaggaggcccugcgccagauccuccgggagagcgggggcaucgacaaggagaccaugggguucaccuacaauggcauccgcaucaacggcgucaccuccgcgugcaagcggagcggguccagcuucuacgccgagaugaaguggcugcuguccaacacggacaacgccgccuuuccccagaugaccaagagcuacaagaacacccgcaagucccccgcgaucaucguguggggcauccaccacagcguguccaccgccgagcagacgaagcucuacgggagcggcaacaagcuggucaccgugggcuccaguaacuaccagcaguccuucgugcccagccccggggcccggccgcaggucaacggccuguccgggcgcaucgacuuccacuggcucauccugaaccccaaugacaccgugaccuucagcuucaacggcgccuucaucgcccccgaccgggcgagcuuccugcgcgggaaguccaucggcauccagaguggcgugcaggucgacgccaacugcgagggggacugcuaccacuccggcgggacgaucaucagcaaccuccccuuccagaauaucgacucccgggccgugggcaagugcccgcgcuacgugaagcagcggagccugcugcucgccaccgggaugaagaacguccccgagauccccaagggccgcggccuguucggggccaucgcgggcuucaucgagaacgggugggagggccugaucgacgggugguauggcuuccggcaccagaacgcccagggcgaggggaccgccgccgacuacaaguccacccagagcgccaucgaccagaucacgggcaagcucaaccgccugaucgcgaagaccaaccagcaguuugagcugaucgacaacgaguucaacgagguggagaagcagaucgggaacgugaucaacuggacccgggacuccaucaccgaggucuggagcuacaaugccgagcuccugaucgccauggagaaccagcacacgaucgaccuggccgacuccgagauggacaagcucuacgagcgcgugaagcgccagcugcgggagaacgccgaggaggacggcaccggcugcuuugagaucuuccacaagugcgacgacgacugcauggcgagcauccgcaacaauaccuacgaccaccggaaguaccgcgaggaggccaugcagaaccggauccagaucgaccccgucaagcuguccagcggguacaaggacgugauccucugguuuuccuucggcgccagcugcuucauccugcuggccaucgugauggggcucgucuucaucugcgugaagaacggcaacaugcgcugcaccaucugcaucuga

SEQ ID NO: 237 - RNA, 1683 nt, Artificial Sequence; identical to SEQ ID NO: 86
  derived and/or modified CDS sequence (AUadapt) from InfluenzaA__AGL44438__HA

SEQ ID NO: 238 - RNA, 1683 nt, Artificial Sequence
  derived and/or modified CDS sequence (AUadapt) from InfluenzaA__EPI445996__HA
auggagaccgugagucugaugaccauccuccugcuggucacgaccuccaacgccgacaagaucugcaucggccaccagucgaccaacuccaccgagacgguggacacccucaccgagaccaacgugcccgucacgcacgccaaggagcugcugcacaccgaccacaacgggaugcucugcgcgaccaaccugggccacccgcugauccucgacacgugcaacguggaggggcugaucuacggcaaccccagcugcgaccugcuccucgggggccgcgagugguccuacaucguggagcggcccagugccgucaacgggaccugcuaccccggcaacguggagaaccuggaggagcugcgcacccuguucuccucguccagcuccuaccagcggauccagaucuucccggacaccaucuggaacgugaccuacacgggcaccucgaaguccugcucggacuccuucuaccgcaacaugcgguggcugacccagaagaacgggcucuaccccguccaggacgcccaguucaccaacaaucgcggcaaggacauccuguucgugugggggauccaccacccgcccacggacaccgcccagaccaaccuguacacccggacggacaccaccaccagcgugacgaccgagaaccucgaccgcaccuucaagccccugaucggcccccggccccuggucaacggccucaucgggcgcaucaacuacuacugguccgugcugaagcccggccagacccugcgggugcgcucgaacgggaaccucaucgccccgugguacggccacguccuguccggcgagucgcacgggcggauccugaagacgaaccucaacagcggcaauugcguggugcagugccagaccgagaagggcgggcugaacuccacccugcccuuccacaacaucucgaaguacgcguucgggaacugccccaaguacaucggcgucaagucccucaagcuggccaucggccugcgcaacgugcccgccaagucgucccggggccucuucggggccaucgcgggguucaucgagggcggguggccgggccugguggccggcugguacggguuccagcacagcaacgaccagggcgucgggaucgccgccgaccgcguguccacccagaaggccguggacaagaucacgucgaaggucaauaacaucguggacaagaugaacaagcaguacgagaucaucgaccacgaguucuccgaggucgagacccggcugaacaugaucaacaacaagaucgacgaccagauccaggacgugugggcguacaacgccgagcuccuggugcugcucgagaaccagaagacccuggacgagcacgacgccaacgucaacaaccuguacaacaaggugaagcgcgcccucggcucgaaugcccuggaggacgggaagggcugcuucgagcuguaccacaagugcgacgaccagugcauggagaccauccggaacggcaccuacaaccgccggaaguaccaggaggagucccgccucgagcgccagaagaucgaggggaucaagcuggagagcgagggcacguacaagauccugaccaucuacuccaccguggcgucgucccugguccucgccaugggguucgccgccuuccuguucugggccaugagcaacggcuccugccggugcaacaucugcaucuga

SEQ ID NO: 239 - RNA, 1695 nt, Artificial Sequence
  derived and/or modified CDS sequence (AUadapt) from InfluenzaA__EPI433309__HA
auggagaagaucgugcugcuccuggccaucgccucgcuggucaaguccgaccagaucugcaucggcuaccacgcgaacaacucgaccgagcaggucgacaccaucauggagaagaacgugacggugacccacgcccaggacauccucgagaagacccacaacgggaagcugugcgaccuggacggcgugaagccccucauccugcgcgacugcuccguggccggguggcugcucggcaacccgaugugcgacaaguucaacgacguccccgaguggagcuacaucguggagaaggccaaccccgccaacgaccugugcuaccccgggaaccugaacgacuacgaggagcucaagcaccuccugucccggaucaaccacuucgagaagauccagaccuuccccaagucguccuggagcgaccacgaggcgucccugggcgugucggccgccugccccuaccagggcaugcccuccuucuuccgcaacgucguguggcugaucaagaagaacaacacguaccccaccaucaagagcuccuacaacaacaccaaccaggaggaccugcucauccugugggggauccaccacucgaacgacgaggccgagcagacccggcuguaccagaacuccaacacguacaucucggugggcaccuccacccucaaccagcgccuggucccgaagaucgcgacccggagcaaggugaacgggcaguccggccgcauggacuucuucuggacgauccugaagcccaacgacgccaucaacuucgagucgaacgggaacuucaucgcccccgaguacgccuacaagaucgugaagaagggcgacagcgccaucaugaaguccgaggucggcuacggggacugcaacaccaagugccagacccccaucggcgcgaucaacucguccaugccguuccacaacauccacccccucaccaucggggagugccccaaguacgucaagagcaacaagcuggugcuggccacgggccuccggaacuccccgcagaucgagacccgcggccuguucggggccaucgccggcuucaucgagggcggguggcaggggaugguggacggcugguacggcuaccaccacucgaacgagcagggguccggcuacgccgcggacaaggagucgacccagaaggccaucgacggggugaccaacaaggugaacuccaucaucgacaagaugaacacgcaguucgaggccgucgagcgggaguucaacaaccuggagcgccggaucgagaaccucaacaagaagauggaggacggcuuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucgggaacggcugcuucgaguucuaccacaagugcgacaacgagugcauggaguccguccggaacggcaccuacgacuacccgcaguacucggaggaggcgcgccugaagcgggaggagaucuccggggugaagcuggagagcaucggcacguaccagauccucuccaucuacucgaccguggccuccagccuggcccuggccaucauggucgccgggcucucccuguggaugugcucgaacggcagccugcagugccgcaucugcaucuga

SEQ ID NO: 240 - RNA, 1683 nt, Artificial Sequence
  derived and/or modified CDS sequence (AUadapt) from InfluenzaA__EPI470859__HA
auggaggccaucccccugaucaccauccuccugguggucaccgccaguaacgcggacaagaucugcaucggcuaccaguccacgaacagcaccgagaccguggacacccugacggagaacaacgugccggucacccacgccaaggagcuccugcacaccgagcacaacgggaugcugugcgccaccaaucucggccgcccccugauccuggacacgugcaccaucgaggggcucaucuacggcaaccccuccugcgaccugcugcucgggggccgggaguggucguacaucguggagcgccccuccgccgugaacggcaugugcuacccggggaacgucgagaaccuggaggagcugcggagcuucuuuuccucggccuccagcuaccagcgcauccagaucuuccccgacaccaucuggaacguguccuacagcggcaccuccaaggcgugcucggacuccuucuaccggagcaugcgcuggcucacgcagaagaacaaugccuaccccauccaggacgcccaguacaccaacaaccgggggaaguccauccuguucauguggggcaucaaccacccgcccaccgacaccgcccagacgaaccuguacacccgcaccgacaccacgaccucgguggcgaccgaggacaucaaccggaccuuuaagcccgucaucgggccccgcccccucgugaacggccugcagggccggaucgacuacuacugguccgugcugaagccggggcagacgcuccgcguccggagcaacggcaaccugaucgcccccugguacgggcacauccugagcggcgagucccacggccgcauccucaagaccgaccugaacucgggguccugcguggugcagugucagaccgagcggggcgggcugaacaccacgcuccccuuccacaacgucagcaaguacgccuucggcaacugccccaaguacgugggggugaagucccugaagcuggccgucggccuccgcaacgugccggcccggucgucccgcggccuguucggggcgaucgccggcuucaucgagggcggguggagcgggcugguggccggcugguauggcuuccagcacuccaacgaccagggggucggcaucgccgccgaccgggacagcacccagcgcgcgaucgacaagaucaccuccaaggugaacaacaucguggacaagaugaacaagcaguacgagaucaucgaccacgaguuuucggaggucgagaaccggcucaacaugaucaacaacaagaucgacgaccagauccaggacaucugggccuacaacgccgagcugcuggugcuccuggagaaccagaagacccuggacgagcacgacgccaacgucaauaaccucuacaacaaggugaagcgcgcccugggguccaacgcgauggaggacggcaaggggugcuucgagcuguaccacaagugcgacgaccagugcauggagacgauccgcaacggcaccuacaaucggcgcaaguacaaggaggagagccggcucgagcgccagaagaucgagggcgugaagcuggaguccgaggggaccuacaagauccugaccaucuacucgacggucgccuccagccucgugaucgccaugggcuucgccgccuuccuguucugggcgauguccaacgggagcugccggugcaacaucugcaucuga

SEQ ID NO: 241 - RNA, 1683 nt, Artificial Sequence
  derived and/or modified CDS sequence (AUadapt) from InfluenzaA__EPI498037__HA
auggagaccgugucgcugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgucaacggccugugcuaccccggcaacguggagaaccuggaggagcuccgcucgcuguucuccagcgcccgguccuaccagcgcauccagaucuucccggacaccaucuggaacgugucguacaacgggaccuccaaggccugcucgggcuccuucuaccggucgaugcgcuggcugacccggaagaacggggacuaccccauccaggacguccaguacaccaacaaccagggcaagaacauccucuucaugugggggaucaaccacccgcccaccgacacgacccagcgcgaccuguacacccggaccgacacgaccaccuccguggcgaccgaggagaucaaccgcaucuucaagccccugaucggcccccggccccucgugaacggccugauggggcgcaucgacuacuacuggucgguccugaagcccggccagacgcuccggaucaaguccgacgggaaccugaucgccccgugguacggccacauccugagcggcgagucgcacgggcgcauccucaagaccgaccugaagcggggcuccugcaccgugcagugccagaccgagaagggcgggcugaacacgacccuccccuuccagaacgugucgaaguacgccuucgggaacugcuccaaguacaucggcaucaagucgcugaagcuggccgucggccuccgcaacgugcccucccggucgucccgcgggcuguucggcgcgaucgccggguucaucgagggcggguggucgggccugguggccggcugguacggguuccagcacuccaacgaccagggcgucgggauggccgccgaccgggacagcacccagaaggcgaucgacaagaucaccuccaaggugaacaacaucguggacaagaugaacaagcaguacgagaucaucgaccacgaguucucggaggucgagacgcgccucaacaugaucaacaacaagaucgacgaccagauccaggacaucugggccuacaacgccgagcugcuggugcuccuggagaaccagaagacccuggacgagcacgacgccaacgugaacaaccucuacaacaaggucaagcgggcccugggcuccaacgcgguggaggacgggaagggcugcuucgagcuguaccacaagugcgacaaccagugcauggagaccauccgcaacggcaccuacaacaagcgcaaguaccaggaggagucgaagcucgagcggcagaagaucgagggggucaagcuggaguccgagggcacguacaagauccugaccaucuacucgaccguggccuccucgcucgugaucgccaugggguucgccgccuuccuguucugggcgauguccaacggcagcugccgcugcaacaucugcaucuga

SEQ ID NO: 242 - RNA, 1683 nt, Artificial Sequence
  derived and/or modified CDS sequence (AUadapt) from InfluenzaA__AGO17847__HA
auggagaccaucagucugaugaccauccuccugaucacgaccgccuccaacgccgacaagaucugcaucggccaccagagcaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuauggcaaccccucgugcgaccugcugcucgaggggcgcgagugguccuacaucguggagcggcccagcgccgucaacgggaccugcuaccccggcaacguggagaaccuggaggagcugcgcacccucuucuccucggccuccagcuaccagcggauccagaucuucccggauaccacguggaacgugaccuacaccgggaccucccgcucgugcuccggcagcuucuaccgguccaugcgcuggcugacgcagaaguccggguucuaccccguccaggacgccaaguacaccaacaaccggggcaagaacauccuguucgugugggggauccaccauccccacaccuacaccgaccagacgacccucuacauccgcaacgacaccaccacgucggugaccaccgaggagcugaaccggaucuucaagcccgucaucgugccgcgccugcucgugaacggccagcagggccggaucgacuacuacuggagcguccugaagcccgggcagacccugcgcgugcgguccaacggcaaccucaucgcgcccugguaugggcacgugcugucgggcggcagccacgggcgcauccugaagacggaccucaaguccggcaacugcgucgugcagugccagaccgagaagggcggccugaacucgacccugcccuuccacaacaucuccaaguacgccuucgggaccugcccgaaguacgugaaggucaauagccucaagcuggccaucggccugcggaacgugcccgcccgcuccaaccggggccucuucggggcgaucgccggcuucaucgagggcggguggcccgggcugguggccggcugguacggcuuccagcacucgaacgaccagggggucggcauggccgccgaccgcgacuccacgcagaaggcgguggacaagaucaccagcaaggugaacaauaucgucgacaagaugaacaagcaguacgagaucaucgaccacgaguucuccgagguggagacccggcugaacaugaucaacaacaagaucgacgaccagauccaggacgucugggccuacaacgccgagcuccuggugcugcucgagaaccagaagacccuggacgagcaugacgccaacgugaacaaccuguacaacaaggucaagcgcgcccucgggucgaacgcgauggaggacggcaaggggugcuucgagcuguaccacaagugcgacgaccaguguauggagaccauccggaacggcacguacgaccgccgcaaguaccgggaggagucccgccuggagcggcagcgcaucgagggcgugaagcucgagagcgaggggaccuacaagauccugaccaucuacuccaccguggccucgucccuggucaucgccaugggcuucgccgccuuccucuucugggcgaugagcaacggguccugccggugcaacaucugcaucuga

SEQ ID NO: 243 - RNA, 1683 nt, Artificial Sequence
  derived and/or modified CDS sequence (AUadapt) from InfluenzaA__ANZ03807__HA
auggagaccgugagucugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugucgcuggaggggcgcgagugguccuacaucguggagcggcccagcgccgucaacggccucugcuaccccggcaacguggagaaccuggaggagcugcgcucccucuucucguccgcccggucguaccagcgcauccagaucuucccggacaccaucuggaacguguccuacgacgggaccucgaccgccugcuccggcucguucuaccgguccaugcgcuggcugacccggaagaacggggacuaccccacccaggacgcgcaguacacgaacaaccagggcaagaacauccuguuuaugugggggaucaaccacccgcccaccgacgacacccagcgcaaccucuacacccggacggacaccaccaccagcgucgccacggaggagaucaaccgcaucuucaagccccugaucggcccccggccccuggugaacggccucauggggcgcaucgacuacuacugguccgugcugaagcccggccagacccugcggaucaagucggacgggaaccucaucgccccgugguacggccacauccugucgggcgagucccacgggcgcauccugaagaccgaccucaagcggggcucgugcaccguccagugccagacggagaagggcgggcugaacaccacccugcccuuccagaacguguccaaguacgccuucgggaacugcagcaaguacaucggcaucaagucccucaagcuggcggugggccugcgcaacguccccucgcgguccucgcgcggccucuucggggccaucgccggguucaucgagggcgggugguccggccugguggccggcugguacggguuccagcacucgaacgaccagggcguggggauggccgcggaccgggacuccacccagaaggccaucgacaagaucacgucgaaggucaacaacaucguggauaagaugaacaagcaguacgagaucaucgaccacgaguucuccgagguggagacccgccugaacaugaucaacaacaagaucgacgaccagauccaggacaucugggccuacaacgccgagcuccugguccugcucgagaaccagaagacccuggacgagcacgacgccaacgugaacaaccuguacaacaaggugaagcgggcgcucggcagcaacgccgucgaggacgggaagggcugcuucgagcuguaccacaagugcaacgaccagugcauggagaccauccgcaacggcacguacaaccgccggaaguaccaggaggaguccaagcuggagcgccagaagaucgagggggugaagcucgagucggagggcaccuacaagauccugaccaucuacuccaccgucgccucgucccuggugaucgccaugggguucgccgcguuccucuucugggccaugucgaacggcagcugccggugcaacaucugcaucuga

SEQ ID NO: 244 - RNA, 1683 nt, Artificial Sequence; identical to SEQ ID NO: 243
  derived and/or modified CDS sequence (AUadapt) from InfluenzaA__EPI680526__HA

SEQ ID NO: 245 - RNA, 1683 nt, Artificial Sequence
  derived and/or modified CDS sequence (AUadapt) from InfluenzaA__ALT20080__HA
auggagaccgugagucugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugagccuggaggggcgcgagugguccuacaucguggagcggcccucggccgucaacggccucugcuaccccggcaacguggagaaccuggaggagcugcgcucccucuucucguccgcccggagcuaccagcgcauccagaucuucccggacaccaucuggaacguguccuacgacgggaccucgaccgccugcuccggcucguucuaccgguccaugcgcuggcugacccggaagaacggggacuaccccauccaggacgcgcaguacaccaacaaccagggcaagaauauccuguucaugugggggaucaaccacccgcccacggacaccacccagcgcgaccucuacacccggacggacaccaccaccagcgucgccacggaggagaucaaccgcaucuucaagccccugaucggcccccggccccuggugaacggccucauggggcgcaucgacuacuacugguccgugcugaagcccggccagacccugcggaucaagucggacgggaaccucaucgccccgugguucggccacauccugucgggcgagucccacgggcgcauccugaagaccaaccucaagcggggcucgugcaccguccagugccagacggagaagggcgggcugaacaccacccugcccuuccagaacguguccaaguacgccuucgggaacugcagcaaguacaucggcaucaagucccucaagcuggcggugggccugcgcaacguccccucgcgguccucgcgcggccucuucggggccaucgccggguucaucgagggcgggugguccggccugguggccggcugguacggguuccagcacagcaacgaccagggcguggggauggccgcggaccgggacuccacccagaaggccaucgacaagaucacgucgaaggucaacaacaucguggauaagaugaacaagcaguacgagaucaucgaccacgaguucuccgagguggagacccgccugaacaugaucaacaacaagaucgacgaccagauccaggacaucugggccuacaacgccgagcuccugguccugcucgagaaccagaagacccuggacgagcacgacgccaacgugaacaaccuguacaacaaggugaagcgggcgcucggcucgaacgccgucgaggacgggaagggcugcuucgagcuguaccacaagugcgacgaccagugcauggagaccauccgcaacggcacguacaaccgccggaaguaccaggaggaguccaagcuggagcgccagaagaucgagggggugaagcucgagagcgagggcaccuacaagauccugaccaucuacuccaccgucgccucgucccuggugaucgccaugggguucgccgcguuccucuucugggccaugucgaacggcagcugccggugcaacaucugcaucuga

SEQ ID NO: 246 - RNA, 1701 nt, Artificial Sequence
  derived and/or modified CDS sequence (AUadapt) from InfluenzaA__AAA16879__HA
auggaggccaagcuguucguccucuucugcaccuucaccgugcugaaggccgacacgaucugcgugggcuaccacgcgaacaacucgaccgacaccguggacaccguccuggagaagaacgugacggugacccacuccgucaaccuccuggaggacagccacaacgggaagcugugcucccucaacggcaucgcgccccugcagcuggggaagugcaacguggccggcuggcuccuggggaacccggagugcgaccugcuccugaccgccaacucgugguccuacaucaucgagaccagcaacuccgagaacggcacgugcuaccccggcgaguucaucgacuacgaggagcugcgcgagcagcucucguccgugagcuccuucgagaaguucgagaucuuccccaaggccucguccuggcccaaccacgagaccaccaagggggucaccgccgccugcagcuacuccggcgccucguccuucuaccggaaccugcuguggaucacgaagaaggggaccagcuacccgaagcucuccaagucguacaccaacaacaagggcaaggaggugcuggugcuguggggcguccaccacccgcccaccacgagcgagcagcagucccucuaccagaacgccgacgcguacgugagcgugggguccucgaaguacaaccgccgguucacccccgagaucgccgcccgccccaagguccggggccaggccgggcgcaugaacuacuacuggacccugcuggaccagggcgacaccaucacguucgaggccaccgggaaccucaucgcgcccugguacgccuucgcccugaacaagggcuccgacagcggcaucaucaccuccgacgcccccgugcacaacugcgacacccggugccagacgccccacggggcccugaacucgucccucccguuccagaacgugcaccccaucaccaucggcgagugccccaaguacaucaagagcaccaagcugcgcauggcgaccgggcugcggaacguccccuccauccagucgcgcggccucuucggggccaucgccggcuucaucgagggcggguggacgggcaugaucgacgggugguacggcuaccaccaccagaacgagcagggguccggcuacgccgccgaccagaaguccacccagaacgcgaucgacggcaucaccaacaaggugaacagcgugaucgagaagaugaacacccaguucacggccgucgggaaggaguucaacaaccuggagcggcgcaucgagaaccugaacaagaagguggacgacggcuuccucgacguguggaccuacaacgccgagcugcugguccuccuggagaacgagcggacccuggacuuccacgacucgaacgugcgcaaccucuacgagaaggucaagucccagcugcggaacaacgccaaggagcuggggaacggcugcuucgaguucuaccacaagugcgacgacgagugcauggagcgcgagaagaacgggaccuacgacuacccgaaguacagcgaggaguccaagcucaaccgggaggagaucgacggcgugaagcuggagucgaugggcguguaccagauccuggccaucuacagcacggucgcguccucgcucgugcugcuggugucccucggggccaucagcuucuggaugugcuccaacggcagccugcagugccgcaucugcaucuga

SEQ ID NO: 247 - RNA, 1701 nt, Artificial Sequence
  derived and/or modified CDS sequence (AUadapt) from InfluenzaA__AAA16880__HA
auggaggccaagcuguucguccucuucugcaccuucaccgugcugaaggccgacacgaucugcgugggcuaccacgcgaacaacucgaccgacaccguggacaccguccuggagaagaacgugacggugacccacuccgucaaccuccuggaggacagccacaacgggaagcugugcucccucaacggcaucgcgccccugcagcuggggaagugcaacguggccggcuggcuccuggggaacccggagugcgaccugcuccugaccgccaacucgugguccuacaucaucgagaccagcaacuccgagaacggcacgugcuaccccggcgaguucaucgacuacgaggagcugcgcgagcagcucucguccgugagcuccuucgagaaguucgagaucuuccccaaggccagcuccuggcccaaccacgagaccaccaagggggucaccgccgccugcucguacuccggcgccagcuccuucuaccggaaccugcuguggaucacgaagaaggggaccucguacccgacccucuccaagagcuacaccaacaacaagggcaaggaggugcuggugcuguggggcguccaccacccgcccacggugaacgagcagcagucgcucuaccagaacgccgacgcguacguguccgucgggagcuccaaguacaaccgccgguucacccccgagaucgccgcccgccccaaggugcggggccaggccgggcgcaugaacuaccacuggacccugcuggaccagggcgacaccaucacguucgaggccaccgggaaccucaucgcgcccugguacgccuucgcccugaacaagggcagcgacuccggcaucaucaccucggacgcccccgugcacaacugcgacacccggugccagacgccccacggggcccugaacuccagccucccguuccagaacguccaccccaucaccaucggcgagugccccaaguacgugaaguccaccaagcugcgcauggcgaccgggcugcggaacgugcccucgauccagucccgcggccucuucggggccaucgccggcuucaucgagggcggguggacgggcaugaucgacgggugguacggcuaccaccaccagaacgagcaggggagcggcuacgccgccgaccagaaguccacccagaacgcgaucgacggcaucaccaacaaggucaacucggugaucgagaagaugaacaccaaguucacggccguggggaaggaguucaacaaccuggagcggcgcaucgagaaccugaacaagaaggucgacgacggcuuccucgacguguggaccuacaacgccgagcugcugguccuccuggagaacgagcggacccuggacuuccacgacuccaacgugcgcaaccucuacgagaaggucaagagccagcugcggaacaacgccaaggagcuggggaacggcugcuucgaguucuaccacaagugcgacgacgagugcaucgaguccgugaagaacgggaccuacgacuacccgaaguacagcgaggaguccaagcucaaccgcgaggagaucgacggcgugaagcuggagucgaugggcguguaccagauccuggccaucuacagcacggucgcguccucgcucgugcugcuggugucccucggggccaucagcuucuggaugugcuccaacggcagccugcagugccggaucugcaucuga

SEQ ID NO: 248 - RNA, 1689 nt, Artificial Sequence
  derived and/or modified CDS sequence (AUadapt) from InfluenzaA__AAA64362__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggagcuucaacgacuacgaggagcugaaguaccugcucuccucggugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggagcgacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccgagaucgccacgcggcccaaggugaacggccucggcagccgcauggaguucuccuggacccugcuggacaugugggacaccaucaacuucgagucgaccgggaaccucaucgcccccgaguacggcuucaagaucuccaagcgggggucgagcggcaucaugaagacggaggggacccuggagaacugcgagaccaagugccagaccccgcugggcgccaucaacacgacccuccccuuccacaacgugcacccccugaccaucggcgagugcccccgcuacgucaaguccgagaagcuggugcucgcgaccgggcugcggaacgugccgcagaucgagucgcgcggccuguucggggccaucgccggcuucaucgagggcggguggcagggcauggucgacgggugguacggcuaccaccacuccaacgaccaggggucgggcuacgccgccgacaaggaguccacgcagaaggcguucgacgggaucaccaacaaggugaacagcgugaucgagaagaugaacacccaguucgaggccgucggcaaggaguucuccaaccucgagcggcgccuggagaaccugaacaagaagauggaggacggcuuccucgacguguggaccuacaacgccgagcugcuggugcucauggagaacgagcggacgcuggacuuccacgacucgaacgucaagaaccuguacgacaaggugcgcaugcagcuccgggacaacgucaaggagcuggggaacggcugcuucgaguucuaccacaagugcgacgacgagugcaugaacuccgugaagaacgggaccuacgacuaccccaaguacgaggaggagucgaagcugaaccgcaacgagaucaagggcgugaagcucuccagcaugggcgucuaccagauccuggccaucuacgccaccguggcggggucccugucgcucgccaucaugauggccggcaucuccuucuggaugugcagcaacgggucccugcagugccggaucugcaucuga

SEQ ID NO: 249 - RNA, 1689 nt, Artificial Sequence
  derived and/or modified CDS sequence (AUadapt) from InfluenzaA__AAA64363__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccagggcgggcgcauggaguucucguggacccuccuggacaugugggacaccaucaacuucgaguccaccggcaaccugaucgcccccgaguacggguucaagaucucgaagcggggcuccucggggaucaugaagacggagggcacccucggcaacugcgagaccaagugccagaccccgcugggggccaucaacacgacccugcccuuccacaacgugcacccccucaccaucggcgagugccccaaguacgucaagagcgagaagcuggugcuggcgaccgggcuccgcaacgugccgcagaucgagucccggggccuguucggggccaucgccggcuucaucgagggcggguggcagggcauggucgacgggugguacggcuaccaccacucgaacgaccagggguccggcuacgccgccgacaaggagucgacgcagaaggcguucgacggcaucaccaacaaggugaacuccgugaucgagaagaucaacacccaguucgaggccgucgagaaggaguucucgaaccuggagcgccggcucgagaaccugaacaagaagauggaggacggguuccuggacguguggaccuacaacgccgagcuccuggugcugauggagaacgagcgcacgcucgacuuccacgacuccagcgucaagaaccuguacgacaaggugcggaugcagcugcgcgacaacgucaaggagcucggcaacgggugcuucgaguucuaccacaagugcgacgacgagugcaugaacuccgugaagaacggcaccuacgacuaccccaaguacgaggaggagucgaagcugaaccggaacgagaucaagggcgugaagcuguccucgauggggaucuaccagauccucgccaucuacgccaccgucgcgggcucccugucgcuggccaucaugauggccgggaucuccuucuggaugugcagcaacggcucccuccagugccgcaucugcaucuga

SEQ ID NO: 250 - RNA, 1689 nt, Artificial Sequence
  derived and/or modified CDS sequence (AUadapt) from InfluenzaA__AAA64365__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccagcggcgagcagaugcucaucaucuggggcguccaccacccgaacgacgagaccgagcagcggacccuguaccagaacguggggacguacguguccgucgggaccucgacccugaacaagcgcuccacccccgacaucgccacgcggcccaagguggacggccucggcucgcgcauggaguucuccuggacccugcuggacaugugggacaccaucaacuucgagagcaccgggaaccucaucgcccccgaguacggcuucaagaucuccaagcgggggucgucgggcaucaugaagacggaggggacccugggcaacugcgagaccaagugccagaccccgcugggcgccaucaacacgacccuccccuuccacaacgugcacccccugaccaucggggagugccccaaguacgucaaguccgagaagcuggugcucgcgaccggccugcgcaacgugccgcagaucgagucgcgggggcuguucggcgccaucgccggguucaucgagggcggcuggcaggggauggucgacggcugguacggguaccaccacuccaacgaccagggcagcggguacgccgccgacaaggaguccacgcagaaggcguucgacggcaucaccaacaaggugaacucggugaucgagaagaugaacacccaguucgaggccgucgagaaggaguucuccaaccucgagcgccggcuggagaaccugaacaagaagauggaggacggcuuccucgacguguggaccuacaacgccgagcugcuggugcucauggagaacgagcgcacgcuggacuuccacgacucgaacgucaagaaccuguacaacaaggugcggaugcagcuccgcgacaacgucaaggagcuggggaacggcugcuucgaguucuaccacaagugcgacgacgagugcaugaacuccgugaagaacgggaccuacgacuaccccaaguacgaggaggagagcaagcugaaccggaacgagaucaagggcgugaagcucuccucgaugggcaucuaccagauccuggccaucuacgccaccgucgcggggucccugucgcucgccaucaugauggccggcaucuccuucuggaugugcagcaacgggucccugcagugccgcaucugcaucuga

SEQ ID NO: 251 - RNA, 1689 nt, Artificial Sequence
  derived and/or modified CDS sequence (AUadapt) from InfluenzaA__AAA64366__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggagucgaacuaccccguggcgaagggguccuacaacaacaccagcggcgagcagaugcucaucaucuggggcguccaccacccgaacgacgagaccgagcagcggacccuguaccagaacguggggacguacguguccgucggcaccucgacccugaacaagcgcuccacccccgacaucgccacgcggcccaaggugaacgggcucggcucgcgcauggaguucuccuggacccugcuggacaugugggacaccaucaacuucgagagcaccggcaaccucaucgcccccgaguacggguucaagaucuccaagcggggcucgucggggaucaugaagacggagggcacccuggagaacugcgagaccaagugccagaccccgcugggggccaucaacacgacccuccccuuccacaacgugcacccccugaccaucggcgagugccccaaguacgucaaguccgagaagcuggugcucgcgaccggccugcgcaacgugccgcagaucgagucgcgggggcuguucggcgccaucgccggguucaucgagggcggguggcagggcauggucgacggcugguacggguaccaccacuccaacgaccagggcagcggguacgccgccgacaaggaguccacgcagaaggcguucgacggcaucaccaacaaggugaacucggugaucgagaagaugaacacccaguucgaggccgucgggaaggaguucuccaaccucgagcgccggcuggagaaccugaacaagaagauggaggacggcuuccucgacguguggaccuacaacgccgagcugcuggugcucauggagaacgagcgcacgcuggacuuccacgacucgaacgucaagaaccuguacgacaaggugcggaugcagcuccgcgacaacgucaaggagcugggcaacgggugcuucgaguucuaccacaagugcgacgacgagugcaugaacuccgugaagaacggcaccuacgacuaccccaaguacgaggaggagagcaagcugaaccggaacgagaucaagggggugaagcucuccucgaugggcgucuaccagauccuggccaucuacgccaccguggcgggcucccugucgcucgccaucaugauggccgggaucuccuucuggaugugcagcaacggcucccugcagugccgcaucugcaucuga

SEQ ID NO: 252 - RNA, 1701 nt, Artificial Sequence
  derived and/or modified CDS sequence (AUadapt) from InfluenzaA__AAA85781__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccagcgccugcaagcgggggcccgacaacggcuucuucucccgccugaacuggcucuacaagucgggcuccaccuaccccgugcagaacgucacgaugcccaacaacgacaacucggacaagcuguacaucuggggcgugcaccacccguccaccgacaaggagcagaccaaccuguacgugcaggccagcgggaaggucaccguguccacgaagcggucgcagcagaccgugauccccaacgucgggagccgccccugggugcggggccucuccucgcgcguguccaucuacuggaccaucgucaagcccggcgacauccuggugaucaacagcaacgggaaccugaucgcgccgcggggcuacuacaagaugcgcaccgggaaguccucgaucaugcgguccgacgcccccaucggcacgugcucguccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagauccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggugaucgagaagaccaacgagaaguuccaccagaucgagaaggaguucuccgaggucgagggccgcauccaggaccuggagaaguacguggaggacacgaagaucgaccuguggagcuacaacgcggagcuccuggucgcccuggagaaccagcacaccaucgaccucaccgacuccgagaugaacaagcuguucgagaagacccggcgccagcugcgggagaacgccgaggacauggggaacggcugcuucaagaucuaccacaagugcgacaaccccugcaucggcucgauccgcaacgggacguacgaccacgacguguaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggcgugccagaagggcaacauccgcugcaacaucugcaucuga

SEQ ID NO: 253 - RNA, 1707 nt, Artificial Sequence
  derived and/or modified CDS sequence (AUadapt) from InfluenzaA__AAC14418__HA
auggagcgcaucgugcugcuccuggccaccgucucgcuggugaaguccgaccagaucugcaucggcuaccacgccaacaacucgaccgagcaggucgacacgaucauggagaagaacgugaccgugacccacgcgcaggacauccucgagcggacccacaacgggaagcugugcgaccugaacggcgugaagccccucauccugcgcgacugcuccgucgccggguggcugcucggcaacccgaugugcgacgaguucaucaacgugcccgaguggagcuacaucguggagaaggccucccccgccaacgaccugugcuaccccgggaacuucaacgacuacgaggagcugaagcaccuccugucgcggaucaaccacuucgagaagauccagaucaucccgaaguccagcugguccaaccacgacgccucguccggcgucagcuccgcgugccccuaccugggccgcucguccuucuuccggaacgugguguggcucaucaagaagaacucgacguaccccaccaucaagcgcuccuacaacaacaccaaccaggaggaccugcugguccucugggggauccaccaccccaacgacgccgccgagcagaccaagcuguaccagaacccgacgaccuacaucagcgugggcaccuccacccugaaccagcggcucgugcccgagaucgccacgcgccccaaggucaacgggcagucgggccggauggaguucuucuggaccauccugaagcccaacgacgcgaucaacuucgagagcaacgggaacuucaucgccccggaguacgccuacaagaucgugaagaagggcgacuccaccaucaugaaguccgagcuggaguacggcaacugcaacaccaagugccagacgcccaugggggccaucaacucgagcaugcccuuccacaacauccacccccucaccaucggcgagugcccgaaguacgugaaguccaaccgccugguccuggccaccgggcuccggaacgcgccccagcgcgagcggcgccggaagaagcgcggccuguucggcgccaucgccggguucaucgagggcggguggcagggcaugguggacgggugguacggcuaccaccacucgaacgagcagggcuccggguacgccgccgaccaggagucgacccagaaggcgaucgacggcgugacgaacaaggucaacuccaucaucaacaagaugaacacccaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacagcaacgugaagaaccucuacgacaagguccggcugcagcugcgcgacaacgccaaggagcucgggaacggcugcuucgaguucuaccacaagugcgacaacgagugcauggaguccgugaagaacggcacguacgacuacccccaguacucggaggaggcccgccugaaccgggaggagaucuccggggugaagcuggagagcaugggcaccuaccagauccucuccaucuacucgaccgucgcguccagccuggcccuggccaucaugguggccgggcucucccuguggaugugcucgaacggcagccugcagugccgcaucugcaucuga

SEQ ID NO: 254 - RNA, 1707 nt, Artificial Sequence
  derived and/or modified CDS sequence (AUadapt) from InfluenzaA__AAC40508__HA
auggagcgcaccgugcugcuccuggccaccgucucgcuggugaaguccgaccagaucugcaucggcuaccacgccaacaacucgacggagcaggucgacaccaucauggagaagaacgugaccgugacccacgcgcaggacauccucgagcggacgcacaacgggaagcugugcgaccugaacggcgugaagccccucauccugcgcgacugcuccgucgccggguggcugcucggcaacccgaugugcgacgaguucaucaacgugcccgaguggagcuacaucguggagaaggccucccccgccaacgaccugugcuaccccgggaacuucaacgacuacgaggagcugaagcaccuccugucgcggaucaaccacuucgagaagauccagaucaucccgaaguccagcugguccaaccacgacgccucguccggcgucagcuccgcgugccccuaccugggccgcucguccuucuuccggaacgugguguggcucaucaagaagaacagcgccuaccccaccaucaagcgcuccuacaacaacaccaaccaggaggaccugcugguccucuggggcgugcaccaccccaacgacgccgccgagcagaccaagcuguaccagaacccgacgaccuacaucucgguggggaccuccacccugaaccagcggcucguccccgagaucgcgacgcgccccaaggugaacgggcagagcggccggauggaguucuucuggaccauccugaagcccaacgacgccaucaacuucgagucgaacgggaacuucaucgccccggaguacgccuacaagaucgugaagaagggcgacuccaccaucaugaaguccgagcuggaguacggcaacugcaacaccaagugccagacgcccaugggggccaucaacagcucgaugcccuuccacaacauccacccccucaccaucggcgagugcccgaaguacgucaaguccaaccgccuggugcuggcgaccgggcuccggaacacgccccagcgcgagcggcgccggaagaagcgcggccuguucggcgccaucgccggguucaucgagggcggguggcagggcaugguggacgggugguacggcuaccaccacagcaacgagcagggcuccugcuacucggccgacaaggaguccacccagaaggccaucgacggggucaccaacaaggugaacagcaucaucaacaagaugaacacccaguucgaggcggugggccgggaguucaacaaccuggagcgccggaucgagaaccucaacaagaagauggaggacggguuccuggacgucuggaccuacaacgccgagcugcucgugcugauggagaacgagcgcacgcuggacuuccacgacuccaacgucaagaaccucuacgacaaggugcggcugcagcugcgcgacaacgccaaggagcucggcaacgggugcuucgaguucuaccacaagugcgacaacgagugcauggagucggugaagaacggcaccuacgacuacccccaguacuccgaggaggcccgccugaaccgggaggagaucagcggcgucaagcuggaguccauggggaccuaccagauccucucgaucuacuccaccguggccagcucccuggcgcuggccaucaugguggccggccucucgcuguggaugugcagcaacgggucccugcagugccgcaucugcaucuga

SEQ ID NO: 255 - RNA, 1701 nt, Artificial Sequence
  derived and/or modified CDS sequence (AUadapt) from InfluenzaA__AAF87274__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugaagggcgucgcgccccugcaccucgggaagugcaacaucgccggcuggcugcuggggaacccggagugcgagcuccuguucaccgccucguccuggagcuacaucguggagacguccaacucggacaacgggaccugcuaccccggcgacuucaucaacuacgaggagcugcgggagcagcucuccagcguguccucguucgagcgcuucgagaucuuccccaaggccaacuccuggcccaaccacgagaccaaccgcggggucaccucggccugcccguacgccggcgccaacuccuucuaccggaaccugaucuggcuggugaagaaggggaacagcuaccccaagcucuccaagucguacaucaacaacaagggcaaggaggugcugguccugugggggauccaccacccgcccacguccaacgaccagcagagccucuaccagaacgcggacgccuacguguucgugggcuccucgaaguacaacaagaaguucaugcccgagaucgccacccggcccaagguccgcggccaggccgggcggaugaacuacuacuggacccugaucgagcccggcgacaccaucacguucgaggccaccgggaaccugguggcgccccgcuacgccuucgccauggagcggggcucgggcuccgggaucaucaucagcgacaccccggugcacgacugcaacgcgaccugccagacgcccaagggcgccaucaacaccaaccuccccuuccagaacauccaccccgucaccaucggggagugcccgaaguacgugaaguccacccgccugcggauggccacgggccugcgcaacauccccucgauccagucccggggccucuucggcgccaucgccggcuucaucgagggcggguggaccgggaugaucgacggcugguacggguaccaccaccagaacgagcagggcagcggcuacgccgccgaccgcaaguccacccagaacgcgaucgacgggaucaccaacaaggugaacucggucaucgagaagaugaacacgcaguucaccgccgugggcaaggaguucaaccaccuggagaagcggaucaagaaccugaacaagaagguggacgacggguuccucgacgucuggaccuacaacgccgagcugcuggugcuccuggagaacgagcgcacccuggacuaccacgacuccaacgucaagaaccucuacgagaaggugcggucgcagcugcgcaacaacgccaaggagaucggcaacgggugcuucgaguucuaccacaagugcgacgacacgugcauggaguccaucaagaacggcaccuacgacuaccccaaguacagcgaggaggccaagcugacccgggaggagaucgacggcgugaagcucgaguccacccgcaucuaccagauccuggcgaucuacucgacgaucgccuccagccugguccuccuggugucccugggggccaucucguucuggaugugcuccaacggcagccuccagugccggaucugcaucuga

SEQ ID NO: 256 - RNA, 1701 nt, Artificial Sequence
  derived and/or modified CDS sequence (AUadapt) from InfluenzaA__AAF87275__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggagaaccgccacaacgggaagcucugcaagcugaagggcgucgcgccccugcaccucgggaagugcaacaucgccggcuggcugcuggggaacccggagugcgagcuccuguucaccgccucguccuggagcuacaucguggagacguccaacucggacaacgggaccugcuaccccggcgacuucaucaacuacgaggagcugcgggagcagcucuccagcguguccucguucgagcgcuucgagaucuuccccaaggccaacuccuggcccaaccacgagaccaaccgcggggucaccucggccugcccguacgccggcgccaacuccuucuaccggaaccugaucuggcuggugaagaaggggaacagcuaccccaagcucuccaagucguacaucaacaacaagggcaaggaggugcugguccugugggggauccaccacccgcccacguccaacgaccagcagagccucuaccagaacgcggacgccuacguguucgugggcuccucgaaguacaacaagaaguucaugcccgagaucgccacccggcccaagguccgcggccaggccgggcggaugaacuacuacuggacccugaucgagcccggcgacaccaucacguucgaggccaccgggaaccugguggcgccccgcuacgccuucgccauggagcggggcucgggcuccgggaucaucaucagcgacaccccggugcacgacugcaacgcgaccugccagacgcccaagggcgccaucaacaccaaccuccccuuccagaacauccaccccgucaccaucggggagugcccgaaguacgugaaguccacccgccugcggauggccacgggccugcgcaacauccccucgauccagucccggggccucuucggcgccaucgccggcuucaucgagggcggguggaccgggaugaucgacggcugguacggguaccaccaccagaacgagcagggcagcggcuacgccgccgaccgcaaguccacccagaacgcgaucgacgggaucaccaacaaggugaacucggucaucgagaagaugaacacgcaguucaccgccgugggcaaggaguucaaccaccuggagaagcggaucgagaaccugaacaagaagguggacgacggguuccucgacgucuggaccuacaacgccgagcugcuggugcuccuggagaacgagcgcacccuggacuaccacgacuccaacgucaagaaccucuacgagaaggugcggucgcagcugcgcaacaacgccaaggagaucggcaacgggugcuucgaguucuaccacaagugcgacgacacgugcauggaguccaucaagaacggcaccuacgacuaccccaaguacagcgaggaggccaagcugacccgggaggagaucgacggcgugaagcucgaguccacccgcaucuaccagauccuggcgaucuacucgacgaucgccuccagccugguccuccuggugucccugggggccaucucguucuggaugugcuccaacggcagccuccagugccggaucugcaucuga

SEQ ID NO: 257 - RNA, 1701 nt, Artificial Sequence
  derived and/or modified CDS sequence (AUadapt) from InfluenzaA__AAF87277__HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugcggggcaucgcgccccuccaccuggggaagugcaacaucgccggcuggcugcucgggaacccggagugcgagcugcuguucaccgccagcuccuggucguacaucguggagaccuccaacagcgacaacggcacgugcuaccccggcgacuucaucaacuacgaggagcuccgcgagcagcuguccucggucuccagcuucgagcgguucgagaucuuccccaaggccuccucguggcccgaccacgagaccaaccgcggggugaccgccgccugcccguacgcgggcgccaacuccuucuaccggaaccugaucuggcucgugaagaaggggaacagcuaccccaagcuguccaagucguacaucaacaacaaggagaaggagguccuggugcucuggggcauccaccacccgcccaccuccacggaccagcagagccuguaccagaacgccgacgccuacguguucgucggguccucgaaguacaacaagaaguucaagcccgagaucgccagccgccccaaggugcggggccaggcgggccgcauggacuacuacuggacccugguggagcccggggacaccaucaccuucgaggccacgggcaaccucgucgugccccgguacgccuucgccaugaagcgcggguccggcucgggcaucaucaucuccgacaccccggugcacgacugcaacacgaccugccagacccccaagggggccaucaacaccagccugcccuuccagaacauccaccccgucaccaucggcgagugcccgaaguacgugaaguccaccaagcugcggauggcgacggggcuccgcaacauccccucgauccagucccggggccuguucggggccaucgccggcuucaucgagggcggguggaccggcaugaucgacgggugguacggcuaccaccaccagaacgagcaggggagcggcuacgccgccgaccgcaaguccacccagaacgcgaucgacggcgugaccaacaaggucaacucggugaucgagaagaugaacacgcaguucaccgccguggggaaggaguucaaccaccuggagaagcggaucgagaaccucaacaagaaggucgacgacggcuuccuggacguguggaccuacaacgccgagcugcucguccugcuggagaacgagcgcacccucgacuaccacgacuccaacgugaagaaccuguacgagaaggugcggagccagcugaagaacaacgccaaggagaucgggaacggcugcuucgaguucuaccacaagugcgacgacacgugcauggaguccgucaagaacgggaccuacgacuaccccaaguacucggaggaguccaagcucaaccgcgaggagaucgacggcgugaagcuggagagcacccggaucuaccagauccuggccaucuacuccaccguggcgucgucccucauccugcuggucagccucggcgccaucucguucuggaugugcuccaacgggagccugcagugccgcaucugcaucuga

SEQ ID NO: 258 - RNA, 1701 nt, Artificial Sequence
  derived and/or modified CDS sequence (AUadapt) from InfluenzaA__AAF87278__HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugcggggcaucgcgccccuccaccuggggaagugcaacaucgccggcuggcugcucgggaacccggagugcgagcugcuguucaccgccagcuccuggucguacaucguggagaccuccaacagcgacaacggcacgugcuaccccggcgacuucaucaacuacgaggagcuccgcgagcagcuguccucggucuccagcuucgagcgguucgagaucuuccccaaggccuccucguggcccaaccacgagaccaaccgcggggugaccgccgccugcccguacgcgggcgccaacuccuucuaccggaaccugaucuggcucgugaagaaggggaacagcuaccccaagcuguccaagucguacaucaacaacaaggagaaggagguccuggugcucuggggcauccaccacccgcccaccuccacggaccagcagagccuguaccagaacgccgacgccuacguguucgucggguccucgaaguacaacaagaaguucaagcccgagaucgccagccgccccaaggugcggggccaggcgggccgcauggacuacuacuggacccugguggagcccggggacaccaucaccuucgaggccacgggcaaccucgucgugccccgguacgccuucgccaugaagcgcggguccggcucgggcaucaucaucuccgacaccccggugcacgacugcaacacgaccugccagacccccaagggggccaucaacaccagccugcccuuccagaacauccaccccgucaccaucggcgagugcccgaaguacgugaaguccaccaagcugcggauggcgacggggcuccgcaacauccccucgauccagucccggggccuguucggggccaucgccggcuucaucgagggcggguggaccggcaugaucgacgggugguacggcuaccaccaccagaacgagcaggggagcggcuacgccgccgaccgcaaguccacccagaacgcgaucgacggcgugaccaacaaggucaacucggugaucgagaagaugaacacgcaguucaccgccguggggaaggaguucaaccaccuggagaagcggaucgagaaccucaacaagaaggucgacgacggcuuccuggacguguggaccuacaacgccgagcugcucguccugcuggagaacgagcgcgcccucgacuaccacgacuccaacgugaagaaccuguacgagaaggugcggagccagcugaagaacaacgccaaggagaucgggaacggcugcuucgaguucuaccacaagugcgacgacacgugcauggaguccgucaagaacgggaccuacgacuaccccaaguacucggaggaguccaagcucaaccgcgaggagaucgacggcgugaagcuggagagcacccggaucuaccagauccuggcgaucuacuccaccguggccucgucccucauccugcuggucagccucggcgccaucucguucuggaugugcuccaacgggagccugcagugccgcaucugcaucuga

SEQ ID NO: 259 - RNA, 1701 nt, Artificial Sequence
  derived and/or modified CDS sequence (AUadapt) from InfluenzaA__AAF87279__HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugcggggcaucgcgccccuccaccuggggaagugcaacaucgccggcuggcugcucgggaacccggagugcgagcugcuguucaccgccagcuccuggucguacaucguggagaccuccaacagcgacaacggcacgugcuaccccggcgacuucaucaacuacgaggagcuccgcgagcagcuguccucggucuccagcuucgagcgguucgagaucuuccccaaggccuccucguggcccaaccacgagaccaaccgcggggugaccgccgccugcccguacgcgggcgccaacuccuucuaccggaaccugaucuggcucgugaagaaggggaacagcuaccccaagcuguccaagucguacaucaacaacaaggagaaggagguccuggugcucuggggcauccaccacccgcccaccuccacggaccagcagagccuguaccagaacgccgacgccuacguguucgucggguccucgaaguacaacaagaaguucaagcccgagaucgccagccgccccaaggugcggggccaggcgggccgcauggacuacuacuggacccugguggagcccggggacaccaucaccuucgaggccacgggcaaccucgucgugccccgguacgccuucgccaugaagcgcggguccggcucgggcaucaucaucuccgacaccccggugcacgacugcaacacgaccugccagacccccaagggggccaucaacaccagccugcccuuccagaacauccaccccgucaccaucggcgagugcccgaaguacgugaaguccaccaagcugcggauggcgacggggcuccgcaacauccccucgauccagucccggggccuguucggggccaucgccggcuucaucgagggcggguggaccggcaugaucgacgggugguacggcuaccaccaccagaacgagcaggggagcggcuacgccgccgaccgcaaguccacccagaacgcgaucgacggcgugaccaacaaggucaacucggugaucgagaagaugaacacgcaguucaccgccguggggaaggaguucaaccaccuggagaagcggaucgagaaccucaacaagaaggucgacgacggcuuccuggacguguggaccuacaacgccgagcugcucguccugcuggagaacgagcgcacccucgacuaccacgacuccaacgugaagaaccuguacgagaaggugcggagccagcugaagaacaacgccaaggagaucgggaacggcugcuucgaguucuaccacaagugcgacgacacgugcauggaguccgucaagaacgggaccuacgacuaccccaaguacucggaggaguccaagcucaaccgcgaggagaucgacggcgugaagcuggagagcacccggaucuaccagauccuggccaucuacuccaccguggcgucgucccucauccugcuggucagccucggcgccaucucguucuggaugugcuccaacgggagccugcagugccgcaucugcaucuga

SEQ ID NO: 260 - RNA, 1701 nt, Artificial Sequence
  derived and/or modified CDS sequence (AUadapt) from InfluenzaA__AAF87281__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggaccgccacaacgggaagcucugcaagcugaagggcaucgcgccccugcaccucgggaagugcaacaucgccggcuggcugcuggggaacccggagugcgagcuccuguucaccgccagcuccuggucguacaucgucgagacguccaacagcgacaacgggaccugcuaccccggcgacuucaucaacuacgaggagcugcgggagcagcucuccucgguguccagcuucgagcgcuucgagaucuuccccaaggccuccucguggcccaaccacgagaccaaccgcggggugaccuccgccugcccguacgccggcgccaacagcuucuaccggaaccugaucuggcuggucaagaaggggaacuccuaccccaagcucucgaaguccuacaucaacaacaagggcaagaaggugcuggugcugugggggauccaccacccgcccacgagcaccgaccagcagucccucuaccagaacgcggacgccuacgucuucgugggcucgagcaaguacaacaagaaguucaugcccgagaucgccacccggcccaaggugcgcggccaggccgggcggaugaacuacuacuggacccugaucgagcccggcgacacgaucaccuucgaggccaccgggaaccuggucgugccccgcuacgcguucgccauggagcggggcuacggcuccgggaucaucaucucggacaccccggugcacgacugcaacacgaccugccagacccccaagggcgccaucaacaccucccuccccuuccagaacauccaccccgucacgaucggggagugcccgaaguacgucaagagcaccaagcugcgcauggccaccggccugcggaacauccccuccauccagucgcgcggccucuucggcgccaucgcgggcuucaucgagggcggguggaccgggaugaucgacggcugguacggguaccaccaccagaacgagcagggcuccggcuacgccgccgaccgcaagagcacgcagaacgccaucgacgggaucaccaacaaggugaacuccgugaucgagaagaugaacacccaguucaccgccgugggcaaggaguucaaccaccuggagaagcggaucgagaaccugaacaagaagguggacgacggguuccucgacgucuggacguacaacgcggagcugcuggugcuccuggagaacgagcggacccuggacuaccacgacucgaacgucaagaaccucuacgagaaggugaagucccagcugaagaacaacgccaaggagaucggcaacgggugcuucgaguucuaccacaagugcgacgacacgugcauggagagcgugaagaacggcaccuacgacuaccccaaguacuccgaggaggccaagcugaaccgcgaggagaucgacggcgucaagcucgagucgacccggaucuaccagauccuggccaucuacuccaccaucgccagcucccuggugcuccuggugucgcugggggcgaucuccuucuggaugugcagcaacggcagccuccagugccgcaucugcaucuga

SEQ ID NO: 261 - RNA, 1701 nt, Artificial Sequence; identical to SEQ ID NO: 259
  derived and/or modified CDS sequence (AUadapt) from InfluenzaA__AAF87282__HA

SEQ ID NO: 262 - RNA, 1701 nt, Artificial Sequence
  derived and/or modified CDS sequence (AUadapt) from InfluenzaA__AAF87283__HA
augaaggccauccuggugguccuccuguacgccuucaccaccgcgaacgccgacacgcugugcaucggcuaccacgccaacaacucgaccgacaccguggacaccgugcucgagaagaacgucacggugacccacuccgugaaccugcuggaggaccgccacaacgggaagcucugcaagcugaagggcgucgcgccccugcaccucgggaagugcaacaucgccggcuggcugcuggggaacccggagugcgagcuccuguucaccgccagcuccuggucguacaucguggagaccuccaacagcgacaacggcacgugcuaccccggcgacuucaucaacuacgaggagcugcgggagcagcucuccucgguguccagcuucgagcgcuucgagaucuuccccaaggccuccucguggcccaaccacgagaccaaccgcggggucaccuccgccugcccguacagcggcgccaacuccuucuaccggaaccugaucuggcuggugaagaaggggaacucguaccccaagcucuccaagagcuacaucaacaacaagggcaaggaggugcugguccugugggggauccaccacccgcccaccuccacggaccagcagucgcucuaccagaacgcggacgccuacguguucgugggcagcuccaaguacaacaagaaguucaugcccgagaucgccacccggcccaagguccgcggccaggccgggcggaugaacuacuacuggacccugaucgagcccggcgacaccaucacguucgaggccaccgggaaccugguggcgccccgcuacgccuucgccauggagcggggcagcggcuccgggaucaucaucucggacaccccgguguacgacugcaacaccgccugccagacgcccaagggcgccaucaacaccucccuccccuuccagaacauccaccccgucaccaucggggagugcccgaaguacgucaagagcaccaagcugcgcauggcgacgggccugcggaacauccccuccauccagucgcgcggccucuucggggccaucgccggcuucaucgagggcggguggaccgggaugaucgacggcugguacggguaccaccaccagaacgagcagggcuccggcuacgcccccgaccgcaagagcacccagaacgccaucgacgggaucaccaacaaggugaacuccgugaucgagaagaugaacacgcaguucaccgcggugggcaaggaguucaaccaccuggagaagcggaucgagaaccugaacaagaagguggacgacggguuccucaacgucuggaccuacaacgccgagcugcuggugcuccuggagaacgagcggacccuggacuaccacgacucgaacgucaagaaccucuacgagaaggugcgcucccagcugaagaacaacgccaaggagaucggcaacgggugcuucgaguucuaccacaagugcgacgacacgugcauggagagcgugaagaacggcaccuacgacuaccccaaguacuccgaggaggcccggcugaaccgcgaggagaucgacggcgucaagcucgagucgacccggaucuaccagauccuggccaucuacuccaccaucgcgagcucccuggugcuccuggugucgcugggggccaucagcuucuggaugugcuccaacggcagccuccagugccgcaucugcaucuga

SEQ ID NO: 263 - RNA, 1701 nt, Artificial Sequence
  derived and/or modified CDS sequence (AUadapt) from InfluenzaA__AAF87284__HA
augaaggccauccuggugguccuccuguacgccuucaccaccgcgaacgccgacacgcugugcaucggcuaccacgccaacaacucgaccgacaccguggacaccgugcucgagaagaacgucacggugacccacuccgugaaccugcuggaggaccgccacaacgggaagcucugcaagcugaagggcgucgcgccccugcaccucgggaagugcaacaucgccggcuggcugcuggggaacccggagugcgagcuccuguucaccgccagcuccuggucguacaucguggagaccuccaacagcgacaacggcacgugcuaccccggcgacuucaucaacuacgaggagcugcgggagcagcucuccucgguguccagcuucgagcgcuucgagaucuuccccaaggccuccucguggcccaaccacgagaccaaccgcggggucaccuccgccugccugcuguucuggagcaagcagcuccugcagaagcugaacauggccggcaagaaggggaacuccuacccgaagcucucgaaguccuacaucaacaacaagggcaaggaggugcuggugcugugggggauccaccacccgcccaccagcacggaccagcagucccucuaccagaacgcggacgccuacgucuucgugggcucgagcaaguacaacaagaaguucaugcccgagaucgccacccggcccaaggugcggggccaggccgggcgcaugaacuacuacuggacccugaucgagcccggcgacaccaucacguucgaggccaccgggaaccuggucgcgccccgguacgccuucgccauggagcgcggcuccggcucggggaucaucaucuccgacacccccguguacgacugcaacaccgccugccagacgccgaagggcgccaucaacaccagccuccccuuccagaacauccaccccgugaccaucggggagugccccaaguacgucaaguccaccaagcugcggauggcgacgggccugcgcaacaucccgucgauccagucccggggccucuucggggccaucgccggcuucaucgagggcggguggaccgggaugaucgacggcugguacggguaccaccaccagaacgagcagggcagcggcuacgccgccgaccgcaaguccacccagaacgcgaucgacgggaucaccaacaaggugaacucggugaucgagaagaugaacacgcaguucaccgccgucggcaaggaguucaaccaccuggagaagcggaucgagaaccugaacaagaagguggacgacggguuccucaacguguggaccuacaacgccgagcugcugguccuccuggagaacgagcgcacccuggacuaccacgacuccaacgugaagaaccucuacgagaagguccggagccagcugaagaacaacgccaaggagaucggcaacgggugcuucgaguucuaccacaagugcgacgacacgugcauggaguccgugaagaacggcaccuacgacuaccccaaguacucggaggaggcccgccugaaccgggaggagaucgacggcgugaagcucgaguccacccgcaucuaccagauccuggcgaucuacagcaccaucgccuccucgcugguccuccuggugucccugggggccaucagcuucuggaugugcagcaacggcucccuccagugccggaucugcaucuga

SEQ ID NO: 264 - RNA, 1701 nt, Artificial Sequence
  derived and/or modified CDS sequence (AUadapt) from InfluenzaA__AAG01749__HA
augucgaccaucaucgcccuguccuacauccucugccugguguucgcccagaagcugcccggcaacgacaacagcaccgcgacgcucugccuggggcaccacgccgucccgaacggcacccuggugaagaccaucaccaacgaccagaucgaggugacgaacgccaccgagcucguccaguccucguccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacucgaacugcuaccccuacgacgugccggacuacgcgucccuccggagccuggucgccuccucgggcacgcuggaguucaccaacgagggguucaacuggaccggcguggcccaggacgggaccuccuacgccugcaagcgcggcagcgugaaguccuucuucucgcggcucaacuggcugcacaagcuggaguacaaguaccccgcgcucaacgucacgaugcccaacaacgacaaguucgacaagcuguacaucuggggcgugcaccaccccuccaccgacagcgaccagaccucccuguacgugcaggccucggggcgcgucaccgugagcacgaagcggucccagcagaccgugaucccgaacaucggcucgcgccccuggguccgggggaucuccagccgcaucuccaucuacuggaccaucgugaagcccggcgacauccuccugaucaacucgaccgggaaccugaucgcgccccggggcuacuucaagauccgcuccggcaagagcuccaucaugcggucggacgccccgaucgacaacugcaacuccgagugcaucacgcccaacgggagcauccccaacgagaagcccuuccagaacgugaaccgcaucaccuacggcgccugcccgcgguacgucaagcagaacacccucaagcuggccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagucgacccaggcggccaucaaccagaucaacggcaagcugaaccggcugaucgagaagaccaacgagaaguuccaccagaucgagaaggaguucuccgaggucgagggccgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacauggggaacggcugcuucaagaucuaccacaagugcgacaacgcgugcaucgggucgauccggaacggcacguacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggcuucaucaugugggccugccagaaggggaacauccgcugcaacaucugcaucuga

SEQ ID NO: 265 - RNA, 1701 nt, Artificial Sequence
  derived and/or modified CDS sequence (AUadapt) from InfluenzaA__AAG01767__HA
augaacaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucaucgagcgcagcaaggccuacuccaacugcuaccccuacgacgugccggacuacucgucccuccggagccugguggcguccagcggcacgcuggaguucaccaacgaggacuucaacuggaccggggucgcccaggacggcggguccuacucgugcaagcgcgaguccgugaaguccuucuucucccggcucaacuggcugcacaagcuggaguacaaguaccccgcccucaacgugaccaugcccaacaacgacaaguucgacaagcuguacaucuggggcguccaccaccccagcacggacuccgagcagaccagccuguacgugcaggccaucgggcgcgugaccgucucgaccaaguccagccagcagacggugaucccgaacaucggcucccggcccugggugcgcggcaucagcucccggaucucgaucuacuggaccaucgucaagcccggggacauccuccugaucuccagcaccggcaaccugaucgcgccccgcggguacuucaagauccggaacggcaaguccagcaucaugcgcuccgacgccccgaucgacaacugcuacucggagugcaucacccccaacggcuccauccccaacgacaagcccuuccagaacgugaaccggaucacguacggggccugcccgaaguacgugaagcagaagacccucaagcuggccaccggcaugcgcaacguccccgagaagcagacccgggggaucuucggcgccaucgcgggguucaucgagaacggcugggagggcaugguggacgggugguacggcuuccgccaccagaacagcgaggggacgggccaggccgccgaccugaaguccacccaggccgccaucgaccaggugaacgggaagcucaaccggcugaucgagaagaccaacgagaaguuccaccagaucgagaaggaguucagcgaggucgagggccgcauccaggaccuggagaaguacguggaggacaccaagaucgaccucugguccuacaacgcggagcugcugguggcccucgagaaccagcacacgaucgaccugaccgacucggagaugaacaagcuguucgagaagacccggaagcagcuccgcgagaacgccgaggacaugggcaacgggugcuucaagaucuaccacaagugcgacaacgccugcaucggcuccauccggaacgggaccuacgaccacgacgucuaccgcgacgaggcccugaacaaccgcuuccagaucaagggcguggagcucaagagcggguacaaggacuggauccuguggaucagcuucgcgaucuccugcuuccugcugugcgucgugcuccugggcuucaucaugugggccugccagaagggcaacauccggugcaacaucugcaucuga

SEQ ID NO: 266 - RNA, 1701 nt, Artificial Sequence
  derived and/or modified CDS sequence (AUadapt) from InfluenzaA__AAG01776__HA
augaacaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacucgccccaccggauccuggacggcaagaacugcacccugaucgacgcccuccugggggacccccacugcgacggcuuccagaacaaggagugggaccuguucaucgagcgcagcaaggccuacuccaacugcuaccccuacgacgugccggacuacagcucccuccggucgcugguggcguccagcggcacgcuggaguucaccaacgaggacuucaacuggaccggggucgcccaggacggcggguccuacagcugcaagcgcgaguccgugaaguccuucuucucccggcucaacuggcugcacaagcuggaguacaaguaccccgcccucaacgugaccaugcccaacaacgacaaguucgacaagcuguacaucuggggcguccaccaccccucgacggacuccgagcagaccagccuguacgugcaggccaucgggcgcgugaccgucagcaccaaguccagccagcagacggugaucccgaacaucggcucccggcccugggugcgcggcaucucgucccggaucagcaucuacuggaccaucgucaagcccggggacauccuccugaucuccagcaccggcaaccugaucgcgccccgcggguacuucaagauccggaacggcaaguccucgaucaugcgcuccgacgccccgaucgacaacugcuacagcgagugcaucacccccaacggcuccauccccaacgacaagcccuuccagaacgugaaccggaucacguacggggccugcccgaaguacgugaagcagaagacccucaagcuggccaccggcaugcgcaacguccccgagaagcagacccgggggaucuucggcgccaucgcgggguucaucgagaacggcugggagggcaugguggacgggugguacggcuuccgccaccagaacagcgaggggacgggccaggccgccgaccugaaguccacccaggccgccaucgaccaggugaacgggaagcucaacuggcugaucgagaagaccaacgagaaguuccaccagaucgagaaggaguucucggaggucgagggccggauccaggaccuggagaaguacguggaggacaccaagaucgaccucugguccuacaacgcggagcugcugguggcccucgagaaccagcacacgaucgaccugaccgacagcgagaugaacaagcuguucgagaagacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucagcuucgcgaucuccugcuuccugcugugcgucgugcuccugggcuucaucaugugggccugccagaagggcaacauccgcugcaacaucugcaucuga

SEQ ID NO: 267 - RNA, 1701 nt, Artificial Sequence; identical to SEQ ID NO: 173
  derived and/or modified CDS sequence (AUadapt) from InfluenzaA__AAG01785__HA

SEQ ID NO: 268 - RNA, 1701 nt, Artificial Sequence
  derived and/or modified CDS sequence (AUadapt) from InfluenzaA__AAK52911__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcaagaacugcacccugaucgacgcccuccugggggacccccacugcgacggcuuccagaacaaggagugggaccuguucguggagcggucgacggccuacuccaacugcuaccccuacgacgugccggacuacgcgagccuccgcucccuggucgccucguccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgggucacggugucgaccaagcgcagccagcagaccgugaucccgaacaucggcucccggcccuggguccgcggggugucgucccggaucagcaucuacuggaccaucgugaagcccggcgacauccuccugaucaacuccacggggaaccugaucgcgccccgcggcuacuucaagauccggucgggcaaguccagcaucaugcgcuccgacgccccgaucgacaacugcaacucggagugcaucacccccaacggguccauccccaacgacaagcccuuccagaacgucaaccggaucaccuacggcgccugcccgcgcuacgugaagcagaacacccucaagcuggccacggggaugcggaacgugcccgagaagcagacccgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcucaaccgccugaucgagaagacgaacgagaaguuccaccagaucgagaaggaguucucggagguggagggccggauccaggaccuggagaaguacguggaggacaccaagaucgaccucugguccuacaacgccgagcugcuggucgcccucgagaaccagcacaccaucgaccugaccgacagcgagaugaacaagcuguucgagcgcacgcggaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagucgggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 269 - RNA, 1701 nt, Artificial Sequence
  derived and/or modified CDS sequence (AUadapt) from InfluenzaA__AAK52912__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcacgaaggccuacagcaacugcuaccccuacgacgugccggacuacgcgucccuccggucgcuggucgccuccagcggcacccuggaguucaccaacgagggguucaacuggaccggcguggcccagaacgggacguccuacgccugcaagcgcggcucggugaaguccuucuucagccggcucaacuggcugcacaagcuggaguacaaguaccccgcgcucaacgucaccaugcccaacaacgacaaguucgacaagcuguacaucuggggcgugcaccaccccuccaccgacucggaccagaccucccuguacgugcaggccagcgggcgcgucacgguguccaccaagcggucgcagcagaccgugaucccgaacaucggcagccgccccuggguccgcgggguguccucgcggaucuccaucuacuggaccaucgugaagcccggcgacauccuccugaucaacagcacggggaaccugaucgcgccccggggcuacuucaagauccgcuccggcaagucguccaucaugcggagcgacgccccgaucgggaacugcaacuccgagugcaucacccccaacggcucgauccccaacgacaagcccuuccagaacgucaaccgcaucaccuacggggccugcccgcgguacgugaagcagaacacccucaagcuggccacgggcaugcgcaacgugcccgagaagcagacccgggggaucuucggcgccaucgccggcuucaucgagaacgggugggagggcauggucgacgggugguacggcuuccgccaccagaacuccgaggggaccggccaggccgccgaccugaaguccacccaggcggccaucaaccagaucaacggcaagcucaaccggcugaucgagaagacgaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacaccaucgaccugaccgacuccgagaugaacaagcuguucgagcggacgcgcaagcagcuccgcgagaacgccgaggacaugggcaacgggugcuucaagaucuaccacaagugcgacaacgcgugcaucggcucgauccggaacgggaccuacgaccacgacguguaccgcgacgaggcccugaacaaccgguuccagaucaagggcgucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 270 - RNA, 1701 nt, Artificial Sequence
  derived and/or modified CDS sequence (AUadapt) from InfluenzaA__AAK71687__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggaccgccacaacgggaagcucugcaagcugcggggcgucgcgccccugcaccucgggaagugcaacaucgccggcuggcugcuggggaacccggagugcgagagccucuucaccgccuccucgugguccuacaucguggagacgagcaacuccgacaacgggaccugcuaccccggcgacuucaucaacuacgaggagcugcgcgagcagcugucguccgugagcuccuucgagcgguucgagaucuuccccgagaccucguccuggcccaaccacgacaccaaccgcggcgucacggccgccugcccgcacgccggcgccaacagcuucuaccggaaccucaucuggcuggcgaagaagggggacuccuaccccaagcugucgaaguccuacaucaacaacaagggcaaggaggugcucgugcugugggggauccaccacccgcccaccagcgccgaccagcagucccuguaccagaacgccgacgccuacgucuucgugggcucgagccgcuacuccaagaaguucaagcccgagaucgccacccggcccaaggugcgcggccaggcggggcggaugaacuacuacuggacccucgucgagcccggcgacaagaucacguucgaggccaccgggaaccugguggugccccgcuacgccuucgccaugaagcggaacagcgaguccggcaucaucaucucggacaucuccguccacgacugcaacacgaccugccagaccccgaagggcgccaucaacaccagccugcccuuccagaacauccaccccgugaccaucggggagugccccaaguacgugaaguccaccaagcuccgcauggcgacgggccugcggaacgucccgucgauccagucccgcgggcuguucggcgccaucgccggguucaucgagggcggcuggaccgggaugaucgacggcugguacggguaccaccaccagaacgagcagggcagcggguacgccgccgaccucaaguccacccagaacgcgaucgacggcaucaccaacaaggugaacucggugaucgagaagaugaacacgcaguucaccgucgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacgacacgugcauggaguccgugaagaacggcaccuacgacuaccccaaguacucggaggaggccaagcugaaccgcgaggagaucgacggggugaagcucgaguccacccggaucuaccagauccuggccaucuacagcaccgucgcguccucgcuggugcucguggucagccugggcacgaucuccuucuggaugugcagcaacggcucccugcagugccgcaucugcaucuga

SEQ ID NO: 271 - RNA, 1707 nt, Artificial Sequence
  derived and/or modified CDS sequence (AUadapt) from InfluenzaA__AAS65618__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagucguccuggagcucccacgaggugagccugggcguguccucggccugcccguaccagggcaaguccagcuucuuccgcaacgucguguggcugaucaagaagaacuccaccuaccccacgaucaagcggagcuacaacaacaccaaccaggaggaccuccuggugcugugggggauccaccaccccaacgacgccgcggagcagaccaagcucuaccagaacccgaccacguacaucuccgucggcaccucgacccugaaccagcgccuggugccccggaucgccacccgcuccaaggugaacgggcagagcggccggauggaguucuucuggacgauccucaagcccaacgacgccaucaacuucgagagcaacgggaacuucaucgcccccgaguacgcguacaagaucgucaagaagggcgacuccaccaucaugaaguccgagcuggaguacggcaacugcaacaccaagugccagaccccgaugggggccaucaacagcucgaugcccuuccacaacauccacccccugacgaucggcgagugccccaaguacgugaaguccaaccgccucgugcuggccaccgggcugcggaacagcccgcagcgcgagcggcgccggaagaagcgcggccucuucggcgccaucgccggguucaucgagggcggguggcagggcauggucgacgggugguacggcuaccaccacuccaacgagcagggcagcggguacgcggccgccaaggaguccacccagaaggccaucgacggcgugaccaacaaggugaacucgaucaucgacaagaugaacacgcaguucgaggccgucgggcgggaguucaacaaccuggagcgccggaucgagaaccugaacaagaagauggaggacggcuuccucgacguguggaccuacaacgcggagcugcugguccucauggagaacgagcgcacccuggacuuccacgacuccaacgugaagaaccuguacgacaaggugcggcuccagcugaaggacaacgccaaggagcuggggaacggcugcuucgaguucuaccacaagugcgacaacgagugcauggagagcguccgcaacggcaccuacgacuacccccaguacuccgaggaggcccggcucaagcgcgaggagaucagcggggugaagcuggaguccaucggcaucuaccagauccugucgaucuacuccacgguggccagcucccucgcccuggcgaucauggucgccgggcugagccucuggaugugcagcaacggcucccugcagugccgcaucugcaucuga

SEQ ID NO: 272 - RNA, 1704 nt, Artificial Sequence
  derived and/or modified CDS sequence (AUadapt) from InfluenzaA__AAT38819__HA
augaauacccagauccuggccuucaucgccugcaugcucaucggcaccaagggggacaagaucugccugggccaccacgcgguggccaacgggacgaaggucaacacccugaccgagcgcggcaucgagguggugaaugccaccgagacggucgagaccgugaacaucaagaagaucugcacccaggggaagcggcccaccgaccucggccagugcggccugcuggggacgcucaucggcccgccccagugcgaccaguuccuggaguucgacgccaaucugaucaucgagcgccgggaggggaccgacgugugcuaccccggcaaguucaccaacgaggagucgcuccgccagauccugcggggguccggcggcaucgacaaggagagcaugggguuuaccuacuccggcauccgcacgaacggggccaccagcgcgugccggcgcuccggcagcuccuucuacgccgagaugaaguggcugcucagcaacuccgauaacgccgccuucccccagaugaccaagagcuaccggaacccgcgcaacaagcccgcgcugaucaucuggggcguccaccacuccgggagugccaccgagcagacgaagcuguacggcuccgggaacaagcucaucaccgugggcagcuccaaguaccagcagagcuucacccccucccccggggcccggccccaggugaacggccagagcggccgcaucgacuuucacuggcugcugcucgacccgaacgacaccgucacguucaccuucaacggggccuucaucgcccccgaucgggcguccuucuuccgcggcgagagccugggggugcagagcgacgugccccuggacuccggcugcgagggggacugcuuucacagcggcggcaccaucgucuccagccucccguuccagaacaucaacccccggaccguggggaagugcccccgcuacgugaagcagacgucccugcugcucgccaccggcaugcggaacguccccgagaauccgaagcaggccuaccagaagcagaugacccgcgggcuguucggcgccaucgccggguucaucgagaacggcugggagggccugaucgacgggugguacggcuuccggcaccagaaugcgcagggggagggcaccgccgccgacuacaagagcacgcaguccgccaucgaccagaucaccggcaagcucaaccgccugaucgacaagaccaaccagcaguucgagcugaucgacaaugaguucagcgagaucgagcagcagaucgggaacgugaucaacuggacccgggacuccaugacggagguguggagcuacaacgccgagcuccuggucgcgauggagaaucagcacaccaucgaccuggccgacuccgagaugaacaagcucuacgagcgcgugcgcaagcagcugcgggagaacgccgaggaggacggcaccgggugcuucgagaucuuucacaagugcgacgaccagugcauggagagcauccgcaacaacaccuaugaccacacgcaguaccggaccgagucccugcagaaccgcauccagaucgaccccgugaagcucagcuccggcuacaaggacaucauccugugguucaguuucggggccuccugcuuccugcuccuggccaucgcgaugggccuggucuucaucugcaucaagaacggcaacaugcggugcaccaucugcaucuga

SEQ ID NO: 273 - RNA, 1707 nt, Artificial Sequence; identical to SEQ ID NO: 73
  derived and/or modified CDS sequence (AUadapt) from InfluenzaA__AAV32636__HA

SEQ ID NO: 274 - RNA, 1707 nt, Artificial Sequence; identical to SEQ ID NO: 73
  derived and/or modified CDS sequence (AUadapt) from InfluenzaA__AAV34704__HA

SEQ ID NO: 275 - RNA, 1707 nt, Artificial Sequence
  derived and/or modified CDS sequence (AUadapt) from InfluenzaA__AAV65826__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccucguucuuccgcaacguggucuggcugaucaagaagaacuccaccuaccccacgaucaagcggagcuacaacaacaccaaccaggaggaccuccuggugcucgggggcauccaccaccccaacgacgcggccgagcagaccaagcuguaccagaacccgaccacguacaucuccguggggaccagcacccugaaccagcgccuggucccccggaucgccacccgcuccaaggugaacggccagucggggcggauggaguucuucuggacgauccucaagcccaacgacgccaucaacuucgagagcaacggcaacuucaucgcgcccgaguacgccuacaagaucgugaagaagggcgacuccaccaucaugaaguccgagcuggaguacgggaacugcaacaccaagugccagaccccgaugggcgccaucaacucgagcaugcccuuccacaacauccacccccugacgaucggggagugccccaaguacgucaaguccaaccgccucgugcuggccaccggccugcggaacagcccgcagcgcgagcggcgccggaagaagcgcggccucuucggggccaucgcgggcuucaucgagggcggguggcaggggaugguggacggcugguacggcuaccaccacuccaacgagcaggggucgggcuacgccgccgacaaggaguccacccagaaggccaucgacggggucaccaacaaggugaacagcaucaucgacaagaugaacacgcaguucgaggccgugggccgggaguucaacaaccuggagcgccggaucgagaaccugaacaagaagauggaggacggguuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcugggcaacggcugcuucgaguucuaccacaagugcgacaacgagugcauggagucggugcggaacgggaccuacgacuacccccaguacuccgaggaggcccgccucaagcgcgaggagaucagcggcgucaagcuggaguccaucgggaucuaccagauccugagcaucuacuccacgguggccucgucccucgcccuggcgaucaugguggccggccugagccucuggaugugcagcaacgggucccugcagugccggaucugcaucuga

SEQ ID NO: 276 - RNA, 1701 nt, Artificial Sequence
  derived and/or modified CDS sequence (AUadapt) from InfluenzaA__AAX11505__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcgagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcgacaucugcaucuga

SEQ ID NO: 277 - RNA, 1701 nt, Artificial Sequence
  derived and/or modified CDS sequence (AUadapt) from InfluenzaA__AAX11525__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 278 - RNA, 1701 nt, Artificial Sequence; identical to SEQ ID NO: 277
  derived and/or modified CDS sequence (AUadapt) from InfluenzaA__AAX11535__HA

SEQ ID NO: 279 - RNA, 1701 nt, Artificial Sequence; identical to SEQ ID NO: 277
  derived and/or modified CDS sequence (AUadapt) from InfluenzaA__AAX11545__HA

SEQ ID NO: 280 - RNA, 1701 nt, Artificial Sequence; identical to SEQ ID NO: 276
  derived and/or modified CDS sequence (AUadapt) from InfluenzaA__AAX11555__HA

SEQ ID NO: 281 - RNA, 1701 nt, Artificial Sequence; identical to SEQ ID NO: 277
  derived and/or modified CDS sequence (AUadapt) from InfluenzaA__AAX11565__HA

SEQ ID NO: 282 - RNA, 1701 nt, Artificial Sequence
  derived and/or modified CDS sequence (AUadapt) from InfluenzaA__AAX11585__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacaacgaccagaucucccuguacgcgcaggccucgggccggaucaccguguccacgaagcgcucgcagcagaccgugaucccgaacaucggcagccggccccgcguccgggacguguccucgcagaucuccaucuacuggaccaucgugaagcccggggacauccugcucaucaacucgaccggcaaccugaucgcgccccgcggguacuucaagauccgguccggcaagagcuccaucaugcgcucggacgccccgaucggcaagugcaacuccgagugcaucacgcccaacgggucgauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccucaagagcacccaggcggccaucaaccagaucaacggcaagcugaaccgccugaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 283 - RNA, 1701 nt, Artificial Sequence; identical to SEQ ID NO: 277
  derived and/or modified CDS sequence (AUadapt) from InfluenzaA__AAX11605__HA

SEQ ID NO: 284 - RNA, 1701 nt, Artificial Sequence; identical to SEQ ID NO: 277
  derived and/or modified CDS sequence (AUadapt) from InfluenzaA__AAX11615__HA

SEQ ID NO: 285 - RNA, 1701 nt, Artificial Sequence
  derived and/or modified CDS sequence (AUadapt) from InfluenzaA__AAX11625__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcgugaccgucuccaccaagcggucgcagcagaccgugaucccgaacaucggguccggccccugggugcgcggcgucagcucccggaucucgaucuacuggacgaucgugaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcucaagcuggccaccgggaugcggaacgugcccgagaagcaggcccgcggcaucuucggggccaucgccggcuucaucgagaacggcugggaggggaugauggacggcugguacggguuccggcaccagaacucggagggcaccgggcaggccgcggaccugaaguccacccaggccgccaucaaccagaucaacggcaagcucaaccgccugaucgagaagacgaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugaccgacucggagaugaacaagcuguucgagcgcacgaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcugugcaucgugcuccugggcuucaucaugugggccugccagaaggggaacauccgcugcaacaucugcaucuga

SEQ ID NO: 286 - RNA, 1701 nt, Artificial Sequence; identical to SEQ ID NO: 277
  derived and/or modified CDS sequence (AUadapt) from InfluenzaA__AAX12731__HA

SEQ ID NO: 287 - RNA, 1701 nt, Artificial Sequence
  derived and/or modified CDS sequence (AUadapt) from InfluenzaA__AAX12741__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucucguucgccaccagcugcuuccuccugugcgucgcccugcucggguucaucaugugggccugccagaagggcaacauccggugcaacaucugcaucuga

SEQ ID NO: 288 - RNA, 1701 nt, Artificial Sequence; identical to SEQ ID NO: 277
  derived and/or modified CDS sequence (AUadapt) from InfluenzaA__AAX12751__HA

SEQ ID NO: 289 - RNA, 1701 nt, Artificial Sequence
  derived and/or modified CDS sequence (AUadapt) from InfluenzaA__AAX12761__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacagcaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgugugcaucgggucgauccgcaacggcaccuacgaccacgacgucuaccgggacgaggcccugaacaaccgcuuccagaucaaggggguggagcugaaguccggcuacaaggacuggauccucuggaucagcuucgcgaucagcugcuuccugcugugcaucguccuccugggcuucaucaugugggccugccagaaggggaacauccggugcaacaucugcaucuga

SEQ ID NO: 290 - RNA, 1701 nt, Artificial Sequence
  derived and/or modified CDS sequence (AUadapt) from InfluenzaA__AAX12791__HA
augaagaccaucaucgcccugucguacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgucucgcuccgcucccugguggcgagcuccggcacccuggaguucaacaacgagucguucaacuggacggggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggaccgacucggaccagaucucccuguacgcgcaggccagcgggcgcgugacggucucgaccaagcggucccagcagaccgugaucccgaacaucggcagcggccccugggugcgcggggucuccucgcggaucuccaucuacuggaccaucgugaagcccggcgacauccuccugaucaacagcacggggaaccugaucgcgccccgcggcuacuucaagauccgguccggcaagagcuccaucaugcgcucggacgccccgaucgacaagugcaacuccgagugcaucacccccaacgggagcauccccaacgacaagcccuuccagaacgugaaccggaucaccuacggccucugcccgcgcuacgucaagcagaacacccugaagcuggccacggggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccucaagucgacccaggccgcgaucaaccagaucaacggcaagcugaaccgccugaucgagaagacgaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugaccgacuccgagaugaacaagcuguucgagcgcacgaagaagcagcuccgggagaacgccgaggacauggggaacggcugcuucaagaucuaccacaagugcgacaacgccugcaucgggucgauccgcaacggcaccuacgaccacgacguguaccgcgacgaggcgcugaacaaccgguuccagaucaagggggucgagcucaaguccggcuacaaggacuggauccuguggaucagcuucgccaucagcugcuuccugcucugcaucgugcugcugggcuucaucaugugggccugccagaaggggaacauccgcugcaacaucugcaucuga

SEQ ID NO: 291 - RNA, 1701 nt, Artificial Sequence
  derived and/or modified CDS sequence (AUadapt) from InfluenzaA__AAX12801__HA
augaagaccaucaucgcccugucguacauccucugccugguguucgcccagaaguuccccggcaacgacaacuccaccgcgacgcugugccucgggcaccacgccgucccgaacggcacccuggugaagaccaucaccaacgaccagaucgaggugacgaacgccaccgagcugguccagagcuccucgaccgaccgcaucugcgacagcccccaccagauccucgacggggagaacugcacccugaucgacgcccugcucggcgacccccacugcgacggguuccagaacaaggagugggaccuguucguggagcggucgaaggccuacuccaacugcuaccccuacgacgugccggacuacgucagccugcgcucccucguggcgucguccggcacgcuggaguucaacaacgagagcuucaacuggaccggcguggcccagaacgggaccuccucggccugcaagcggcgcuccgacaagagcuucuucucccggcugaacuggcuccaccagcugaaguacaaguaccccgcccugaacgucaccaugcccaacaacgagaaguucgacaagcucuacaucuggggcgugcaccaccccgggacggacucggaccagaucucccuguacgcgcaggccagcggccgcgugaccgucucgaccaagcggucccagcagaccgugaucccgaacaucgggagccgccccugggugcggggcgucuccucgcgcaucuccaucuacuggacgaucgugaagcccggcgacauccugcucaucaacagcaccgggaaccugaucgcgccccggggcuacuucaagauccgcuccgggaaguccuccaucaugcggucggacgccccgaucggcaagugcaacuccgagugcaucacccccaacggcagcauccccaacgacaagcccuuccagaacgugaaccgcaucaccuacggggccugcccgcgguacgucaagcagaacacgcugaagcucgccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagucgacgcaggcggccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcaucgugcugcucggcuucaucaugugggccugccagaagggcaacauccggugcaacaucugcaucuga

SEQ ID NO: 292 - RNA, 1701 nt, Artificial Sequence
  derived and/or modified CDS sequence (AUadapt) from InfluenzaA__AAX12811__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcgugaccgucuccaccaagcggucgcagcagaccgugaucccgaacaucgggucccgccccugggugcggggcgucagcucccgcaucucgaucuacuggacgaucgugaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacucggaggggaccggccaggccgccgaccugaaguccacgcaggcggccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcaucgugcuccugggcuucaucaugugggccugccagaagggcaacauccggugcaacaucugcaucuga

SEQ ID NO: 293 - RNA, 1701 nt, Artificial Sequence
  derived and/or modified CDS sequence (AUadapt) from InfluenzaA__AAX34061__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucgacuggaccggggugacccagaacggcaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcgggcggaucaccgugucgacgaagcgcucccagcagaccgugaucccgaacaucggcucgcggccccgcguccgggacguguccagccgcaucuccaucuacuggaccaucgugaagcccggcgacauccugcucaucaacucgaccgggaaccugaucgcgccccggggcuacuucaagauccgcuccgggaaguccuccaucaugcggucggacgccccgaucggcaagugcaacuccgagugcaucacgcccaacggcagcauccccaacgacaagcccuuccagaacgucaaccgcaucaccuacggggccugcccgcgguacaucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggaccggccaggccgccgaccucaagucgacccaggcggccaucaaccagaucaacgggaagcugaaccggcugaucggcaagaccaacgagaaguuccaccagaucgagaaggaguucuccgaggucgagggccgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaaggggguggagcugaaguccggcuacaaggacuggauccuguggaucucguucgccaucagcugcuuccuccugugcguggcccugcucggcuucaucaugugggccugccagaaggggaacauccggugcaacaucugcaucuga

SEQ ID NO: 294 - RNA, 1701 nt, Artificial Sequence
  derived and/or modified CDS sequence (AUadapt) from InfluenzaA__AAX35821__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcaaguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacaacgaccagaucucgcuguacgcgcaggccuccggccgcaucaccgugucgacgaagcggagccagcagaccgugaucccgaacaucggcucccgcccccggguccgcgacgugucgucccggaucucgaucuacuggaccaucgugaagcccggggacauccugcucaucaacuccaccggcaaccugaucgcgccccgcggguacuucaagauccggagcggcaaguccucgaucaugcgcuccgacgccccgaucggcaagugcaacucggagugcaucacgcccaacggguccauccccaacgacaagcccuuccagaacgucaaccggaucaccuacggcgccugcccgcgcuacgugaagcagaacacccugaagcucgccaccgggaugcggaacgugcccgagcgccagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 295 - RNA, 1701 nt, Artificial Sequence; identical to SEQ ID NO: 276
  derived and/or modified CDS sequence (AUadapt) from InfluenzaA__AAX35831__HA

SEQ ID NO: 296 - RNA, 1701 nt, Artificial Sequence
  derived and/or modified CDS sequence (AUadapt) from InfluenzaA__AAX35851__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucucguucgccaucagcugcuuccugcugugcaucgugcuccugggcuucaucaugugggccugccagaaggggaacauccggugcaacaucugcaucuga

SEQ ID NO: 297 - RNA, 1701 nt, Artificial Sequence
  derived and/or modified CDS sequence (AUadapt) from InfluenzaA__AAX35861__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcaucaccguguccaccaagcggucgcagcagaccgucaucccgaacaucggguccggccccugggugcgcggcgugagcucccggaucucgaucuacuggacgaucgucaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugauggacggcugguacggguuccggcaccagaacucggagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacaccaucgaccugacggacucggagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaaggggguggagcucaagagcggcuacaaggacuggauccuguggaucagcuucgccaucuccugcuuccugcugugcaucguccuccugggcuucaucaugugggccugccagaaggggaacauccgcugcaacaucugcaucuga

SEQ ID NO: 298 - RNA, 1701 nt, Artificial Sequence
  derived and/or modified CDS sequence (AUadapt) from InfluenzaA__AAX35871__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucggccucccgcaucugcgacagcccccaccagauccuggacggggagaacugcacccugaucgacgcccuccugggcgacccccacugcgacggguuccagaacaaggagugggaccuguucguggagcgguccaaggcguacucgaacugcuaccccuacgacgugccggacuacgucucccuccgcagccugguggccuccucgggcacccuggaguucaacaacgaguccuucaacuggacgggcguggcccagaacgggaccagcuucgccugcaagcggcgcuccgacaagagcuucuucucccggcucaacuggcugcaccagcugaaguacaaguaccccgcgcucaacgucaccaugcccaacaacgagaaguucgacaagcuguacaucuggggcgugcaccaccccgggaccgacucggaccagaucucccuguacgcccaggccagcggccgcgugacggucucgaccaagcggucccagcagaccgugaucccgaacaucgggagcggccccugggugcgcggcgucuccucgcggaucuccaucuacuggaccaucgugaagcccggggacauccuccugaucaacagcacgggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcgccugcccgcgcuacgucaagcagaacacccucaagcuggccacggggaugcggaacgugcccgagaagcagacccgcggcaucuucggggccaucgccggcuucaucgagaacggcugggaggggaugauggacggcugguacggguuccggcaccagaacuccgagggcaccgggcaggccgcggaccucaagucgacccaggccgccaucaaccagaucaacggcaagcugaaccgccugaucgagaagacgaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgggagaacgcggaggacauggggaacggcugcuucaagaucuaccacaagugcgacaacgccugcaucgggucgauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 299 - RNA, 1701 nt, Artificial Sequence; identical to SEQ ID NO: 292
  derived and/or modified CDS sequence (AUadapt) from InfluenzaA__AAX38237__HA

SEQ ID NO: 300 - RNA, 1701 nt, Artificial Sequence
  derived and/or modified CDS sequence (AUadapt) from InfluenzaA__AAX47515__HA
augaaggccaucaucgcccugucguacauccucugccugguguucgcgcagaagcugcccggcaacgacaacuccaccgccacccucugccuggggcaccacgccgucccgaacggcacgcuggugaagaccaucaccaacgaccagaucgaggugaccaacgccacggagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggcguacuccaacugcuaccccuacgacgugccggacuacgucucgcuccgcucccugguggccagcuccggcacccuggaguucaacaacgagucguucaacuggacggggguggcccagaacggcaccuccagcgccugcaagcggcgcuccgacaagucguucuucucccggcucaacuggcugcaccagcugaaguacaaguaccccgcgcucaacgucaccaugcccaacaacgagaaguucgacaagcuguacaucuggggcgugcaccaccccgggaccgacagcgaccagaucucccuguacgcccaggccucggggcgcgugacggucagcaccaagcggucccagcagaccgugaucccgaacaucggcucgcgccccugggugcggggcgucuccagccgcaucuccaucuacuggaccaucgugaagcccggggacauccuccugaucaacucgacgggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacccucaagcuggccacggggaugcgcaacgugcccgagaagcagacccggggcaucuucggggccaucgccggcuucaucgagaacggcugggaggggaugauggacggcugguacggguuccgccaccagaacuccgagggcaccgggcaggccgcggaccugaaguccacccaggccgccaucaaccagaucaacggcaagcucaaccggcugaucgagaagacgaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugaccgacuccgagaugaacaagcuguucgagcggacgaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaagggggucgagcugaaguccggcuacaaggacuggauccucuggaucucguucgccaucagcugcuuccugcugugcaucgugcuccugggcuucaucaugugggccugccagaaggggaacauccggugcaacaucugcaucuga

SEQ ID NO: 301 - RNA, 1701 nt, Artificial Sequence
  derived and/or modified CDS sequence (AUadapt) from InfluenzaA__AAX47525__HA
augaagaccaucaucgcccugucguacauccucugccugguguucgcccagaagcugcccggcaacgacaacuccaccgcgacgcucugcauggggcaccacgccgucccgaacggcacccuggugaagaccaucaccaacgaccagaucgaggugacgaacgccaccgagcugguccagucguccagcaccgggcgcaucugcgacucgccccaccagauccucgacggcgagaacugcacccugaucgacgcccugcucggggacccccacugcgacggcuuccagaacaaggagugggaccuguucguggagcggagcaaggccuacuccaacugcuaccccuacgacgugccggacuacgucucgcugcgcucccucguggcgagcuccggcacgcuggaguucaacaacgagucguucaacuggaccgggguggcccagaacggcaccuccagcgccugcaagcggcgcuccaacaagucguucuucucccggcugaacuggcuccaccagcugaaguacaaguaccccgcccugaacgucaccaugcccaacaacgagaaguucgacaagcucuacaucuggggcgugcaccaccccgacacggacagcaaccagaucucccuguacgcgcaggccucggggcgcgugaccgucagcaccaagcggucccagcagaccgugaucccgaacaucgggucgggccccugggugcgcggcgucuccagccggaucuccaucuacuggacgaucgugaagcccggggacauccugcucaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcgccugcccgcgcuacgucaagcagaacacgcugaagcucgccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacaccaucgaccucacggacuccgagaugaacaagcuguucgagcgcaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaagggggucgagcugaaguccggcuacaaggacuggauccuguggaucucguucgccaucagcugcuuccuccugugcaucgugcugcucggcuucaucaugugggccugccagaaggggaacauccgcugcaacaucugcaucuga

SEQ ID NO: 302 - RNA, 1701 nt, Artificial Sequence; identical to SEQ ID NO: 292
  derived and/or modified CDS sequence (AUadapt) from InfluenzaA__AAX47535__HA

SEQ ID NO: 303 - RNA, 1701 nt, Artificial Sequence; identical to SEQ ID NO: 276
  derived and/or modified CDS sequence (AUadapt) from InfluenzaA__AAX56380__HA

SEQ ID NO: 304 - RNA, 1701 nt, Artificial Sequence; identical to SEQ ID NO: 276
  derived and/or modified CDS sequence (AUadapt) from InfluenzaA__AAX56390__HA

SEQ ID NO: 305 - RNA, 1701 nt, Artificial Sequence
  derived and/or modified CDS sequence (AUadapt) from InfluenzaA__AAX56400__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcgagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacaucuccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggccugccagaagggcaacauccggugcgacaucugcaucuga

SEQ ID NO: 306 - RNA, 1701 nt, Artificial Sequence; identical to SEQ ID NO: 276
  derived and/or modified CDS sequence (AUadapt) from InfluenzaA__AAX56410__HA

SEQ ID NO: 307 - RNA, 1701 nt, Artificial Sequence
  derived and/or modified CDS sequence (AUadapt) from InfluenzaA__AAX56420__HA
augaagaccaucaucgcccugucguacuuccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucgacuggaccggcgugacccagaacgggaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccucgggccggaucaccgugagcacgaagcgcucccagcagaccgugaucccgaacaucggcucgcggccccgcguccgggacguguccucgcgcaucuccaucuacuggaccaucgugaagcccggggacauccugcucaucaacagcaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 308 - RNA, 1701 nt, Artificial Sequence
  derived and/or modified CDS sequence (AUadapt) from InfluenzaA__AAX56430__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgccagccugcggucccucgucgcgucguccgggacccuggaguucaacaacgagucguucaacuggaccggcgugacccagaacgggacguccagcgccugcgagcgccgguccaacaagucguucuucucccgccugaacuggcucacccaccugaaguacaaguaccccgcccugaacgugaccaugcccaacaacgagaaguucgacaagcucuacaucuggggcguccaccaccccgggaccgacucggaccagaucucccuguacgcccaggcgagcggccggaucacggugucgaccaagcgcucccagcagaccgugaucccgaacaucggcucgcggccccgcguccgggacguguccagccgcaucuccaucuacuggaccaucgugaagcccggggacauccugcucaucaacucgacgggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggccgcgaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcgacaucugcaucuga

SEQ ID NO: 309 - RNA, 1701 nt, Artificial Sequence
  derived and/or modified CDS sequence (AUadapt) from InfluenzaA__AAX56440__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucguccaccgggcgcaucugcgacagcccccaccagauccuggacggcgagaacugcacccugaucgacgcccuccugggggacccccacugcgacggcuuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccgggguggcccagaacggcaccagcuccgccugcaagcggcgcucggacaaguccuucuucucgcggcucaacuggcugcaccagcugaaguacaaguaccccgcccucaacgucaccaugcccaacaacgagaaguucgacaagcuguacaucuggggcgugcaccaccccgggacggacaacgaccagaucucccuguacgcgcaggccagcgggcgcgugaccgucuccaccaagcggucgcagcagaccgugaucccgaacaucggcagcggccccugggugcgcggggucuccucgcggaucuccaucuacuggacgaucgugaagcccggcgacauccuccugaucaacagcaccgggaaccugaucgcgccccgcggcuacuucaagauccgguccggcaagucguccaucaugcgcucggacgccccgaucgggaagugcaacuccgagugcaucacccccaacggcagcauccccaacgacaagcccuuccagaacgugaaccggaucaccuacgggccgugcccccgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccucaagucgacgcaggccgcgaucaaccagaucaacggcaagcugaaccgccugaucgagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgccugcaucggcucgauccgcaacgggaccuacgaccacgacguguaccgcgacgaggcgcugaacaaccgguuccagaucaagggcgucgagcugaaguccggcuacaaggacuggauccucuggaucagcuucgccaucuccugcuuccugcugugcaucgugcuccugggguucaucaugugggccugccagaagggcaacauccgcugcaacaucugcaucuga

SEQ ID NO: 310 - RNA, 1701 nt, Artificial Sequence; identical to SEQ ID NO: 292
  derived and/or modified CDS sequence (AUadapt) from InfluenzaA__AAX56450__HA

SEQ ID NO: 311 - RNA, 1701 nt, Artificial Sequence
  derived and/or modified CDS sequence (AUadapt) from InfluenzaA__AAX56460__HA
augaagaccaucaucgcccugucguacauccucugccugguguucgcccagaagcugcccgagaacgacaacuccaccgcgacgcucugccugggccaccacgccgucccgaacgggacccuggugaagaccaucaccaacgaccagaucgaggugacgaacgccaccgagcucguccagucguccagcaccggccgcaucugcgacucgccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccggcguggcccagaacgggaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcggccgcgugaccgucucgaccaagcggucccagcagaccgugaucccgaacaucgggagccgccccugggugcggggcgucuccucgcgcaucuccaucuacuggacgaucgugaagcccggcgacauccuccugaucaacucgaccgggaaccugaucgcgccccggggcuacuucaagauccgcuccgggaaguccuccaucaugcggagcgacgccccgaucggcaagugcaacuccgagugcaucacccccaacggcucgauccccaacgacaagcccuuccagaacgugaaccgcaucacccacgggccgugcccccgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggccgcgaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggguacaaggacuggauccucuggaucucguucgccaucagcugcuuccugcugugcaucgugcuccugggcuucaucaugugggccugccagaagggcaacauccggugcaacaucugcaucuga

SEQ ID NO: 312 - RNA, 1701 nt, Artificial Sequence
  derived and/or modified CDS sequence (AUadapt) from InfluenzaA__AAX56470__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagaugcgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucucguucgccaucagcugcuuccugcugugcaucgugcuccugggcuucaucaugugggccugccagaaggggaacauccggugcaacaucugcaucuga

SEQ ID NO: 313 - RNA, 1701 nt, Artificial Sequence; identical to SEQ ID NO: 296
  derived and/or modified CDS sequence (AUadapt) from InfluenzaA__AAX56480__HA

SEQ ID NO: 314 - RNA, 1701 nt, Artificial Sequence
  derived and/or modified CDS sequence (AUadapt) from InfluenzaA__AAX56510__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagcaagaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcaucgugcuccugggcuucaucaugugggccugccagaaggggaacauccgcugcaacaucugcaucuga

SEQ ID NO: 315 - RNA, 1701 nt, Artificial Sequence; identical to SEQ ID NO: 292
  derived and/or modified CDS sequence (AUadapt) from InfluenzaA__AAX56520__HA

SEQ ID NO: 316 - RNA, 1701 nt, Artificial Sequence
  derived and/or modified CDS sequence (AUadapt) from InfluenzaA__AAX56530__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacccccaaccccaagaacggcacgugcuaccccggcuacuucgccgacuacgaggagcuccgggagcagcugucguccgugagcuccuucgagcgcuucgagaucuucccgaaggacagcuccuggcccaaccacaccgucaccaagggggugaccgccagcugcucccacaacggcaagucguccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucagcgugcucuccucgcacuacucccgccgguucaccccggagaucgccaagcgccccaaggugcgggaccaggagggccgcaucaacuacuacuggacccugcuggagcccggggacaccaucaucuucgaggccaacggcaaccucaucgcccccugguacgccuucgcgcugagccggggguucggcuccggcaucaucaucagcaacgccuccaugggggagugcgacgccaagugccagacgccgcagggcgccaucaacagcucccugcccuuccagaacguccaccccgugaccaucggggagugccccaaguacgugcgcucgaccaagcuccggauggucaccggccugcgcaacgugccguccauccagagccgggggcuguucggcgccaucgcgggcuucaucgagggcggguggacggggaugaucgacggcugguacggguaccaccaccagaacgagcagggcuccggcuacgccgccgaccagaaguccacccagaacgccaucaacgggaucaccaacaaggugaacagcaucaucgagaagaugaacacccaguucacggccgucggcaaggaguucaacaagcucgagaagcgcauggagaaccugaacaagaagguggacgacggguuccuggacaucuggaccuacaacgcggagcuccuggugcugcucgagaacgagcggacccuggacuuccacgaccugaacgucaagaaccucuacgagaaggugaagaaccagcugaagaacaacgccaaggagaucggcaacgggugcuucgaguucuaccacaagugcaacaacgagugcauggagagcgucaagaacggcaccuacgacuaccccaaguacuccaaggagucgaagcugaaccgcgagaagaucgacggcgugaagcucgaguccauggggguguaccagauccuggccaucuacagcacggucgccagcucccuggugcuccuggugagccugggcgccaucuccuucuggaugugcagcaacgggucccuccagugccggaucugcaucuga

SEQ ID NO: 317 - RNA, 1701 nt, Artificial Sequence
  derived and/or modified CDS sequence (AUadapt) from InfluenzaA__AAX56550__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 318 - RNA, 1701 nt, Artificial Sequence
  derived and/or modified CDS sequence (AUadapt) from InfluenzaA__AAX56560__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccucgaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 319 - RNA, 1701 nt, Artificial Sequence
  derived and/or modified CDS sequence (AUadapt) from InfluenzaA__AAX56570__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcgugaccgucuccaccaagcggucgcagcagaccgugaucccgaacaucgggucccgccccugggugcggggcgucagcuccggcaucucgaucuacuggacgaucgugaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacucggagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcugugcaucgugcuccugggcuucaucaugugggccugccagaaggggaacauccgcugcaacaucugcaucuga

SEQ ID NO: 320 - RNA, 1701 nt, Artificial Sequence
  derived and/or modified CDS sequence (AUadapt) from InfluenzaA__AAX56590__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccuccacggacucggaccagaucagccuguacgcgcaggccuccgggcgcgugaccgucagcaccaagcggucccagcagaccgugaucccgaacaucggcucgcgccccugggugcgcggggucuccagccggaucuccaucuacuggacgaucgugaagcccggcgacauccuccugaucaacucgaccggcaaccugaucgcgccccggggguacuucaagauccgcuccggcaagagcuccaucaugcggucggacgccccgaucgggaagugcaacuccgagugcaucacccccaacggcagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacgggugggagggcaugauggacggcugguacggguuccgccaccagaacuccgagggcaccgggcaggccgccgaccucaagucgacgcaggcggccaucaaccagaucaacggcaagcugaaccggcugaucgagaagaccaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacggcugcuucaagaucuaccacaagugcgacaacgcgugcaucgggucgauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcugugcaucgugcuccugggguucaucaugugggccugccagaagggcaacauccggugcaacaucugcaucuga

SEQ ID NO: 321 - RNA, 1701 nt, Artificial Sequence; identical to SEQ ID NO: 318
  derived and/or modified CDS sequence (AUadapt) from InfluenzaA__AAX56600__HA

SEQ ID NO: 322 - RNA, 1701 nt, Artificial Sequence
  derived and/or modified CDS sequence (AUadapt) from InfluenzaA__AAX57644__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccguggucaagcccggggacauccugcucaucaacucgaccggcaaccugaucgcgccccggggguacuucaagaugcgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 323 - RNA, 1701 nt, Artificial Sequence; identical to SEQ ID NO: 276
  derived and/or modified CDS sequence (AUadapt) from InfluenzaA__AAX57654__HA

SEQ ID NO: 324 - RNA, 1701 nt, Artificial Sequence; identical to SEQ ID NO: 292
  derived and/or modified CDS sequence (AUadapt) from InfluenzaA__AAX57664__HA

SEQ ID NO: 325 - RNA, 1701 nt, Artificial Sequence
  derived and/or modified CDS sequence (AUadapt) from InfluenzaA__AAX57684__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcgugaccgucuccaccaagcggucgcagcagaccgugaucccgaacaucggguccggccccugggugcgcggcgucagcucccggaucucgaucuacuggacgaucgugaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacucggagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcugugcaucgugcuccugggcuucaucaugugggccugccagaaggggaacauccgcugcaacaucugcaucuga

SEQ ID NO: 326 - RNA, 1701 nt, Artificial Sequence; identical to SEQ ID NO: 296
  derived and/or modified CDS sequence (AUadapt) from InfluenzaA__AAX57694__HA

SEQ ID NO: 327 - RNA, 1701 nt, Artificial Sequence; identical to SEQ ID NO: 318
  derived and/or modified CDS sequence (AUadapt) from InfluenzaA__AAX57704__HA

SEQ ID NO: 328 - RNA, 1701 nt, Artificial Sequence; identical to SEQ ID NO: 296
  derived and/or modified CDS sequence (AUadapt) from InfluenzaA__AAX57714__HA

SEQ ID NO: 329 - RNA, 1701 nt, Artificial Sequence; identical to SEQ ID NO: 325
  derived and/or modified CDS sequence (AUadapt) from InfluenzaA__AAX57733__HA

SEQ ID NO: 330 - RNA, 1701 nt, Artificial Sequence
  derived and/or modified CDS sequence (AUadapt) from InfluenzaA__AAX57734__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcaacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcgugaccgucuccaccaagcggucgcagcagaccgugaucccgaacaucggguccggccccugggugcgcggcgucagcucccggaucucgaucuacuggacgaucgugaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacucggagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcugugcaucgugcuccugggcuucaucaugugggccugccagaaggggaacauccgcugcaacaucugcaucuga

SEQ ID NO: 331 - RNA, 1701 nt, Artificial Sequence; identical to SEQ ID NO: 317
  derived and/or modified CDS sequence (AUadapt) from InfluenzaA__AAX57744__HA

SEQ ID NO: 332 - RNA, 1701 nt, Artificial Sequence; identical to SEQ ID NO: 317
  derived and/or modified CDS sequence (AUadapt) from InfluenzaA__AAX57764__HA

SEQ ID NO: 333 - RNA, 1701 nt, Artificial Sequence; identical to SEQ ID NO: 317
  derived and/or modified CDS sequence (AUadapt) from InfluenzaA__AAX57774__HA

SEQ ID NO: 334 - RNA, 1701 nt, Artificial Sequence
  derived and/or modified CDS sequence (AUadapt) from InfluenzaA__AAX57784__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucguccaccagccgcaucugcgacucgccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccggcguggcccagaacgggaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucgggccgcgugaccgucagcaccaagcggucccagcagaccgugaucccgaacaucgggucgcgccccugggugcggggcgucuccagccgcaucuccaucuacuggacgaucgugaagcccggcgacauccuccugaucaacucgaccgggaaccugaucgcgccccggggcuacuucaagauccgcuccgggaaguccuccaucaugcggagcgacgccccgaucggcaagugcaacuccgagugcaucacccccaacggcucgauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggcggccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggguacaaggacuggauccucuggaucucguucgccaucagcugcuuccugcugugcaucgugcuccugggcuucaucaugugggccugccagaagggcaacauccggugcaacaucugcaucuga

SEQ ID NO: 335 - RNA, 1701 nt, Artificial Sequence
  derived and/or modified CDS sequence (AUadapt) from InfluenzaA__AAX57794__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucucgucccggaucagcauccacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 336 - RNA, 1701 nt, Artificial Sequence; identical to SEQ ID NO: 317
  derived and/or modified CDS sequence (AUadapt) from InfluenzaA__AAX57814__HA

SEQ ID NO: 337 - RNA, 1701 nt, Artificial Sequence
  derived and/or modified CDS sequence (AUadapt) from InfluenzaA__AAX57824__HA
augaagaccaucaucgcccugucguacauccucugcaugguguucgcccagaagcugcccgucaacgacaacuccaccgcgacgcugugccucggccaccacgccgugccgaacgggacccuggugaagaccaucaccaacgaccacaucgaggucacgaacgccaccgagcuggugcagagcuccucgaccggccgcaucugcgacagcccccaccagauccucgacggggagaacugcacccugaucgacgcccugcucggcgacccccacugcgacggguuccagaacaaggagugggaccuguucguggagcggucgacggccuacuccaacugcuaccccuacgacgucccggacuacgcgagccugcgcucccucguggccucguccggcacccuggaguucaacaacgagagcuucaacuggaccggcguggcccagaacgggaccuccagcgccugcaagcggcgcuccaucaagucguucuucucccggcugaacuggcuccaccagcugaaguacaaguaccccgcgcugaacgucacgaugcccaacaacgagaaguucgacaagcucuacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccugcucaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcugaaccggcucaucgagaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggacccgcaagcagcugcgcgagaacgcggaggacaugggcaacggcugcuucaagaucuaccacaagugcgacaacgccugcaucggguccauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggguucaucaugugggccugccagaagggcaacauccgcugcaacaucugcaucuga

SEQ ID NO: 338 - RNA, 1701 nt, Artificial Sequence; identical to SEQ ID NO: 317
  derived and/or modified CDS sequence (AUadapt) from InfluenzaA__AAX57834__HA

SEQ ID NO: 339 - RNA, 1701 nt, Artificial Sequence; identical to SEQ ID NO: 317
  derived and/or modified CDS sequence (AUadapt) from InfluenzaA__AAX57844__HA

SEQ ID NO: 340 - RNA, 1701 nt, Artificial Sequence
  derived and/or modified CDS sequence (AUadapt) from InfluenzaA__AAX57864__HA
augaagaccaucaucgcccugucguacuuccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgucgcuccgcucccugguggccagcuccggcacccuggaguucaacaacgagucguucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucagcucccggaucucgaucuacuggaccaucgugaagcccggcgacauccuccugaucaacuccaccggcaaccugaucgcgccccggggguacuucaagauccgcagcggcaaguccucgaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 341 - RNA, 1701 nt, Artificial Sequence; identical to SEQ ID NO: 317
  derived and/or modified CDS sequence (AUadapt) from InfluenzaA__AAX57874__HA

SEQ ID NO: 342 - RNA, 1701 nt, Artificial Sequence; identical to SEQ ID NO: 317
  derived and/or modified CDS sequence (AUadapt) from InfluenzaA__AAX57884__HA

SEQ ID NO: 343 - RNA, 1701 nt, Artificial Sequence
  derived and/or modified CDS sequence (AUadapt) from InfluenzaA__AAX57894__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccaggugcuggacggggagaacugcacccugaucgacgcccuccugggcgacccccacugcgacggguuccagaacaaggagugggaccuguucgucgagcggucgacggccuacuccaacugcuaccccuacgacgugccggacuacgcgagccuccgcucccugguggccucguccggcacccuggaguucaacaacgagagcuucaacuggaccggcgucgcccagaacgggaccuccagcgccugcaagcggcgcuccaucaagucguucuucucccggcucaacuggcugcaccagcugaaguacaaguaccccgcgcucaacgugacgaugcccaacaacgagaaguucgacaagcuguacaucuggggcgugcaccaccccagcaccgacuccgaccagaucucgcuguacgcccaggccagcgggcgcgucaccguguccaccaagcggucgcagcagacggugaucccgaacaucggcucccgccccuggguccgcggggugagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 344 - RNA, 1701 nt, Artificial Sequence
  derived and/or modified CDS sequence (AUadapt) from InfluenzaA__AAX57924__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgucgcuccgcucccugguggccagcuccggcacccuggaguucaacaacgagucguucaacuggaccggcguggcccagaacgggaccuccuucgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccaccccuccaccgacucggaccagaucucccuguacgcccaggccagcgggcgcgugaccgucucgaccaagcggucccagcagacggugaucccgaacaucggcagccgccccugggugcgcggggucuccagccggaucuccaucuacuggaccaucgugaagcccggcgacauccuccugaucaacucgaccggcaaccugaucgcgccccggggguacuucaagauccgcuccggcaagagcuccaucaugcggucgaacgccccgaucgggaagugcaacuccgagugcaucacccccaacggcagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgcggaccugaaguccacccaggccgccaucaaccagaucaacggcaagcucaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggucgauccggaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 345 - RNA, 1701 nt, Artificial Sequence; identical to SEQ ID NO: 317
  derived and/or modified CDS sequence (AUadapt) from InfluenzaA__AAX57934__HA

SEQ ID NO: 346 - RNA, 1701 nt, Artificial Sequence
  derived and/or modified CDS sequence (AUadapt) from InfluenzaA__AAX57944__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagcggccccugggugcgcggggucuccucgcggaucuccaucuacuggacgaucgugaagcccggcgacauccuccugaucaacagcaccgggaaccugaucgcgccccgcggcuacuucaagauccgguccggcaagucguccaucaugcgcagcgacgccccgaucgggaagugcaacuccgagugcaucacccccaacggcucgauccccaacgggaagcccuuccagaacgugaaccggaucaccuacggcgccugcccgcgcuacgucaagcagaacacgcucaagcuggccaccgggaugcggaacgugcccgagaagcagacccgcggcaucuucggcgccaucgccggguucaucgagaacggcugggaggggaugauggacggcugguacggguuccggcaccagaacuccgagggcaccggccaggccgccgaccugaaguccacgcaggcggccaucaaccagaucaacgggaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggucgauccgcaacggcaccuacgaccacgacguguaccgcgacgaggcccugaacaaccgguuccagaucaaguccgucgagcucaagagcggcuacaaggacuggauccuguggaucagcuucgccaucuccugcuuccugcugugcaucgugcuccugggguucaucaugugggccugccagaagggcaacauccgcugcaacaucugcaucuga

SEQ ID NO: 347 - RNA, 1701 nt, Artificial Sequence
  derived and/or modified CDS sequence (AUadapt) from InfluenzaA__AAX76623__HA
augaagaccaucaucgcccugucguacauccucugccugguguucgcccagaagcugcccggcaacgacaaguccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacaucuccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugcgguccggcuacaaggacuggauccuguggaucucguucgccaucagcugcuuccuccugugcguggccucccugggguucaucaugugggccugccagaagggcaacauccgcugcaacaucugcaucuga

SEQ ID NO: 348 - RNA, 1701 nt, Artificial Sequence
  derived and/or modified CDS sequence (AUadapt) from InfluenzaA__AAX76643__HA
augaagaccaucaucgcccugucguacuuccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcgagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccucgggccggaucaccgugagcacgaagcgcucccagcagaccgugaucccgaacaucggcucgcggccccgcguccgggacguguccucgcgcaucuccaucuacuggaccaucgugaagcccggggacauccugcucaucaacagcaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcgacaucugcaucuga

SEQ ID NO: 349 - RNA, 1701 nt, Artificial Sequence
  derived and/or modified CDS sequence (AUadapt) from InfluenzaA__AAX76653__HA
augaagaccaucaucgcccugucguacuuccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcgagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguucgcgcaggccagcggccggaucaccgugucgacgaagcgcucccagcagaccgugaucccgaacaucggcagcgggccccggguccgcgacguguccucgcggaucuccaucuacuggaccaucgugaagcccggcgacauccugcucaucaacucgaccgggaaccugaucgcgccccgcggcuacuucaagauccgguccggcaagagcuccaucaugcgcucggacgccccgaucgggaagugcaacuccgagugcaucacgcccaacggcagcauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggcuucaucgagaacgggugggagggcauggucgacgggugguacggcuuccggcaccagaacuccgaggggaccggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgggagaacgccgaggacauggggaacggcugcuucaagaucuaccacaagugcgacaacgcgugcaucgggagcauccgcaacggcacguacgaccacgacguguaccgcgacgaggcccucaacaaccgguuccagaucaagggcguggagcugaaguccggguacaaggacuggauccuguggaucucguucgccaucagcugcuuccuccugugcgucgcccugcucggcuucaucaugugggccugccagaaggggaacauccgcugcgacaucugcaucuga

SEQ ID NO: 350 - RNA, 1701 nt, Artificial Sequence
  derived and/or modified CDS sequence (AUadapt) from InfluenzaA__AAX76663__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgggccccugggugcgcggggucuccagccggaucuccaucuacuggacgaucgugaagcccggcgacauccuccugaucaacucgaccgggaaccugaucgcgccccgcggcuacuucaagauccgguccggcaagagcuccaucaugcgcucggacgccccgaucgggaagugcaacuccgagugcaucacccccaacggcagcauccccaacgacaagcccuuccagaacgugaaccggaucaccuacgggccgugcccccgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggccgcgaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcgcugaacaaccgguuccagaucaagggcgucgagcugaaguccggcuacaaggacuggauccucuggaucucguucgccaucagcugcuuccugcugugcaucgugcuccugggguucaucaugugggccugccagaagggcaacauccgcugcaacaucugcaucuga

SEQ ID NO: 351 - RNA, 1701 nt, Artificial Sequence
  derived and/or modified CDS sequence (AUadapt) from InfluenzaA__AAX76673__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagcgguacguggaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 352 - RNA, 1701 nt, Artificial Sequence
  derived and/or modified CDS sequence (AUadapt) from InfluenzaA__AAX76683__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcgugaugcgguccaacgccccgaucgggaagugcaacucggagugcaucacccccaacggcuccauccccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 353 - RNA, 1701 nt, Artificial Sequence; identical to SEQ ID NO: 317
  derived and/or modified CDS sequence (AUadapt) from InfluenzaA__AAX76713__HA

SEQ ID NO: 354 - RNA, 1701 nt, Artificial Sequence
  derived and/or modified CDS sequence (AUadapt) from InfluenzaA__AAX76723__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgucgcuccgcucccugguggccagcuccggcacccuggaguucaacaacgagucguucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgaggaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucagcuccaucaucucgaucuacuggaccaucgugaagcccggcgacauccuccugaucaacuccaccggcaaccugaucgcgccccggggguacuucaagauccggagcggcaaguccucgaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucucggaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 355 - RNA, 1701 nt, Artificial Sequence
  derived and/or modified CDS sequence (AUadapt) from InfluenzaA__AAX76733__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgaccgcaucugcgacucgccccaccagauccuggacgggggcaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaagaacaaguaccccgcccucaacgucgcgaugcccaacaacgagaaguucgacaagcuguacaucuggggcgugcaccaccccgggaccgacucggaccagaucucccuguacgcccaggccucggggcgcgugacggucagcaccaagcggucccagcagaccgugaucccgaacaucggcucgcgcccccgggugcgcgacaucuccagccggaucuccaucuacuggaccaucgucaagcccggcgacauccuccugaucaacucgacggggaaccugaucgcgccccgcggcuacuucaagauccgguccgggaaguccuccaucaugcgcucggacgccccgaucggcaagugcaacuccgagugcaucacccccaacggcagcauccccaacgacaagcccuuccagaacgugaaccggaucaccuacggggccugcccgcgcuacgugaagcagaacacccucaagcuggccacgggcaugcggaacguccccgagaagcagacccgcgggaucuucggcgccaucgccggguucaucgagaacggcugggagggcaugguggacgggugguacggcuuccggcaccagaacuacgaggggaccggccaggccgcggaccugaaguccacccaggccgccaucaaccagaucaacgggaagcucaaccgccugaucgagaagacgaacgagaaguuccaccagaucgagaaggaguucucggagguggagggccggauccaggaccuggagaaguacgucgaggacaccaagaucgaccucugguccuacaacgccgagcugcugguggcccucgagaaccagcacaccaucgaccugaccgacagcgagaugaacaagcuguucgagcgcacgaagaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcucaagucgggguacaaggacuggauccuguggaucuccuucgccaucagcugcuuccugcugugcaucgugcuccugggcuucaucaugugggccugccagaagggcaacauccgcugcaacaucugcaucuga

SEQ ID NO: 356 - RNA, 1701 nt, Artificial Sequence
  derived and/or modified CDS sequence (AUadapt) from InfluenzaA__AAX76743__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccaacaagucguucuucucccggcucaacuggcugcaccagcugaagaacaaguaccccgcccucaacgucgcgaugcccaacaacgagaaguucgacaagcuguacaucuggggcgugcaccaccccgggaccgacagcgaccagaucucccuguacgcccaggccucggggcgcgugacggucagcaccaagcggucccagcagaccgugaucccgaacaucggcucgcgcccccgggugcgcgacaucuccucgcggaucuccaucuacuggaccaucgucaagcccggcgacauccuccugaucaacagcacggggaaccugaucgcgccccgcggcuacuucaagauccgguccgggaaguccuccaucaugcgcucggacgccccgaucggcaagugcaacuccgagugcaucacccccaacggcagcauccccaacgacaagcccuuccagaacgugaaccggaucaccuacggggccugcccgcgcuacgugaagcagaacacccucaagcuggccacgggcaugcggaacguccccgagaagcagacccgcgggaucuucggcgccaucgccggguucaucgagaacggcugggagggcaugauggacgggugguacggcuuccggcaccagaacuccgaggggaccggccaggccgcggaccucaagucgacccaggccgccaucaaccagaucaacgggaagcugaaccgccugaucgagaagacgaacgagaaguuccaccagaucgagaaggaguucuccgagguggagggccggauccaggaccuggagaaguacguggaggacaccaagaucgaccucuggucguacaacgccgagcugcuggucgcccucgagaaccagcacaccaucgaccugaccgacuccgagaugaacaagcuguucgagcgcacgaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcguggagcugaaguccggguacaaggacuggauccucuggaucucguucgccaucagcugcuuccugcugugcaucguccuccugggcuucaucaugugggccugccagaagggcaacauccgcugcaacaucugcaucuga

SEQ ID NO: 357 - RNA, 1701 nt, Artificial Sequence
  derived and/or modified CDS sequence (AUadapt) from InfluenzaA__AAX76763__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacaucuccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugaucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 358 - RNA, 1701 nt, Artificial Sequence; identical to SEQ ID NO: 277
  derived and/or modified CDS sequence (AUadapt) from InfluenzaA__AAY18086__HA

SEQ ID NO: 359 - RNA, 1701 nt, Artificial Sequence
  derived and/or modified CDS sequence (AUadapt) from InfluenzaA__AAY18096__HA
augaagaccaucaucgcccugucgugcauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcgagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcgacaucugcaucuga

SEQ ID NO: 360 - RNA, 1701 nt, Artificial Sequence; identical to SEQ ID NO: 292
  derived and/or modified CDS sequence (AUadapt) from InfluenzaA__AAY18106__HA

SEQ ID NO: 361 - RNA, 1701 nt, Artificial Sequence; identical to SEQ ID NO: 292
  derived and/or modified CDS sequence (AUadapt) from InfluenzaA__AAY18116__HA

SEQ ID NO: 362 - RNA, 1701 nt, Artificial Sequence
  derived and/or modified CDS sequence (AUadapt) from InfluenzaA__AAY18126__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagggcuucaacuggaccggggugacccagaacggcaccucguccgccugcaagcgcaagucgaacaaguccuucuucucgcggcugaacuggcucacgcaccugaaguacaaguaccccgcccugaacgugaccaugcccaacaacgagaaguucgacaagcucuacaucuggggcguccaccaccccgggaccgacaacgaccagaucucccuguacgcgcaggccagcggccgcaucaccguguccacgaagcggucgcagcagaccgugaucccgaacaucgggucgcgcccccggguccgcgacguguccagccggaucuccaucuacuggaccaucgugaagcccggcgacauccugcucaucaacucgaccgggaaccugaucgcgccccgcggcuacuucaagauccgguccggcaagucguccaucaugcgcucggacgccccgaucgggaagugcaacuccgagugcaucacgcccaacggcagcauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggcuucaucgagaacgggugggagggcauggucgacgggugguacggcuuccggcaccagaacuccgaggggaccggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgggagaacgccgaggacauggggaacggcugcuucaagaucuaccacaagugcgacaacgcgugcaucgggucgauccgcaacggcacguacgaccacgacguguaccgcgacgaggcccucaacaaccgguuccagaucaagggcguggagcugaaguccggguacaaggacuggauccuguggaucagcuucgccaucuccugcuuccuccugugcgucgcccugcucggcuucaucaugugggccugccagaaggggaacauccgcugcaacaucugcaucuga

SEQ ID NO: 363 - RNA, 1701 nt, Artificial Sequence
  derived and/or modified CDS sequence (AUadapt) from InfluenzaA__AAY18136__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacaucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 364 - RNA, 1701 nt, Artificial Sequence; identical to SEQ ID NO: 317
  derived and/or modified CDS sequence (AUadapt) from InfluenzaA__AAY18156__HA

SEQ ID NO: 365 - RNA, 1701 nt, Artificial Sequence; identical to SEQ ID NO: 317
  derived and/or modified CDS sequence (AUadapt) from InfluenzaA__AAY18176__HA

SEQ ID NO: 366 - RNA, 1701 nt, Artificial Sequence; identical to SEQ ID NO: 317
  derived and/or modified CDS sequence (AUadapt) from InfluenzaA__AAY18186__HA

SEQ ID NO: 367 - RNA, 1701 nt, Artificial Sequence; identical to SEQ ID NO: 318
  derived and/or modified CDS sequence (AUadapt) from InfluenzaA__AAY18564__HA

SEQ ID NO: 368 - RNA, 1701 nt, Artificial Sequence
  derived and/or modified CDS sequence (AUadapt) from InfluenzaA__AAY18585__HA
augaagaccaucaucgcccugucguacauccucugccugguguucgcccagaagcugcccgagaacgacaacuccaccgcgacgcucugccugggccaccacgccgucccgaacgggacccuggugaagaccaucaccaacgaccagaucgaggugacgaacgccaccgagcucguccagucguccagcaccggccgcaucugcgacucgccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccggcguggcccagaacgggaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucgggccgcgugaccgucagcaccaagcggucccagcagaccgugaucccgaacaucgggucgcgccccugggugcggggcgucuccagccgcaucuccaucuacuggacgaucgugaagcccggcgacauccuccugaucaacucgaccgggaaccugaucgcgccccggggcuacuucaagauccgcuccgggaaguccuccaucaugcggagcgacgccccgaucggcaagugcaacuccgagugcaucacccccaacggcucgauccccaacgacaagcccuuccagaacgugaaccgcaucaccuacgggccgugcccccgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggccgcgaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggguacaaggacuggauccucuggaucucguucgccaucagcugcuuccugcugugcaucgugcuccugggcuucaucaugugggccugccagaagggcaacauccggugcaacaucugcaucuga

SEQ ID NO: 369 - RNA, 1701 nt, Artificial Sequence; identical to SEQ ID NO: 277
  derived and/or modified CDS sequence (AUadapt) from InfluenzaA__AAY18611__HA

SEQ ID NO: 370 - RNA, 1701 nt, Artificial Sequence; identical to SEQ ID NO: 318
  derived and/or modified CDS sequence (AUadapt) from InfluenzaA__AAY27843__HA

SEQ ID NO: 371 - RNA, 1701 nt, Artificial Sequence; identical to SEQ ID NO: 277
  derived and/or modified CDS sequence (AUadapt) from InfluenzaA__AAY27853__HA

SEQ ID NO: 372 - RNA, 1701 nt, Artificial Sequence
  derived and/or modified CDS sequence (AUadapt) from InfluenzaA__AAY27863__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagaucaucgacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccuggucgccagcuccgggacgcucgaguucaacaacgagucguucgacuggaccggcgugacccagaacgggaccuccagcgccugcaagcgccgguccaacaagucguucuucucccgccugaacuggcugacgcaccucaaguacaaguaccccgcccugaacgugaccaugcccaacaacgagaaguucgacaagcuguacaucuggggcguccaccaccccgggaccgacucggaccagaucucccucuacgcgcaggccagcggccggaucaccgugucgacgaagcgcucccagcagaccgugaucccgaacaucggcagccggccccgcguccgggacguguccucgcgcaucuccaucuacuggaccaucgugaagcccggggacauccugcugaucaacucgaccggcaaccucaucgcgccccggggguacuucaagauccgcuccggcaagagcuccaucaugaucucggacgccccgaucggcaagugcaacuccgagugcaucacgcccaacgggagcauccccaacgacaagcccuuccagaacgucaaccggaucaccuacggcgccugcccgcgcuacgugaagcagaacacccugaagcuggccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccucaagucgacccaggcggccaucaaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggucguacaacgccgagcugcucgucgcccuggagaaccagcacaccaucgaccugaccgacuccgagaugaacaagcuguucgagcgcaccaagaagcagcuccgggagaacgccgaggacaugggcaacgggugcuucaagaucuaccacaagugcgacaacgcgugcaucggcagcauccgcaacgggacguacgaccacgacguguaccgcgacgaggcccugaacaaccgguuccagaucaagggcguggagcucaaguccggcuacaaggacuggauccuguggaucucguucgccaucagcugcuuccugcucugcgucgcccugcugggguucaucaugugggccugccagaagggcaacauccgcugcaacaucugcaucuga

SEQ ID NO: 373 - RNA, 1701 nt, Artificial Sequence; identical to SEQ ID NO: 296
  derived and/or modified CDS sequence (AUadapt) from InfluenzaA__AAY27959__HA

SEQ ID NO: 374 - RNA, 1701 nt, Artificial Sequence; identical to SEQ ID NO: 276
  derived and/or modified CDS sequence (AUadapt) from InfluenzaA__AAY27994__HA

SEQ ID NO: 375 - RNA, 1701 nt, Artificial Sequence; identical to SEQ ID NO: 276
  derived and/or modified CDS sequence (AUadapt) from InfluenzaA__AAY28004__HA

SEQ ID NO: 376 - RNA, 1701 nt, Artificial Sequence; identical to SEQ ID NO: 276
  derived and/or modified CDS sequence (AUadapt) from InfluenzaA__AAY28265__HA

SEQ ID NO: 377 - RNA, 1701 nt, Artificial Sequence
  derived and/or modified CDS sequence (AUadapt) from InfluenzaA__AAY28275__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucagcaucuacuggacgaucgucaagcccggcgacauccuccugaucaacuccaccgggaaccugaucgcgccccggggcuacuucaagauccgcucggggaaguccagcgugaugcgguccgacgccucgaucggcaagugcaacuccgagugcaucaccccgaacggcagcauccccaacgacaagcccuuccagaacgugaaccgcaucaccuacggggccugcccccgguacgucaagcagaacacgcucaagcuggccaccggcaugcgcaacgugccggagaagcagacccgggggaucuucggcgccaucgccggguucaucgagaacggcugggagggcaugguggacgggugguacggcuuccgccaccagaacuccgaggggaccggccaggccgcggaccugaaguccacgcaggccgccaucaaccagaucaacgggaagcucaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcucaagucgggguacaaggacuggauccuguggaucuccuucgccaucagcugcuuccugcugugcgucgugcuccugggcuucaucaugugggccugccagaagggcaacauccggugcaacaucugcaucuga

SEQ ID NO: 378 - RNA, 1701 nt, Artificial Sequence
  derived and/or modified CDS sequence (AUadapt) from InfluenzaA__AAY28285__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucguccaccgggcgcaucugcgacagcccccaccagauccuggacggcgagaacugcacccugaucgacgcccuccugggggacccccacugcgacggcuuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccgggguggcccagaacggcaccagcuccgccugcaagcggcgcucggacaaguccuucuucucgcggcucaacuggcugcaccagcugaaguacaaguaccccgcccucaacgucaccaugcccaacaacgagaaguucgacaagcuguacaucuggggcgugcaccaccccgggacggacaacgaccagaucucccuguacgcgcaggccagcgggcgcgugaccgucuccaccaagcggucgcagcagaccgugaucccgaacaucggcagccgccccugggugcggggcgucuccucgcgcaucuccaucuacuggacgaucgugaagcccggggacauccuccugaucaacagcaccggcaaccugaucgcgccccggggguacuucaagauccgcuccggcaagucguccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccucaagucgacgcaggccgcgaucaaccagaucaacggcaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggucgauccgcaacggcaccuacgaccacgacguguaccgggacgaggcgcugaacaaccgcuuccagaucaagggggucgagcugaaguccggcuacaaggacuggauccucuggaucagcuucgccaucuccugcuuccugcugugcaucgugcuccugggcuucaucaugugggccugccagaaggggaacauccggugcaacaucugcaucuga

SEQ ID NO: 379 - RNA, 1701 nt, Artificial Sequence
  derived and/or modified CDS sequence (AUadapt) from InfluenzaA__AAY28295__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggcaagaucaccgugucgacgaagcggucccagcagaccgugaucccgaacaucggcucgcgcccccggguccgcgacguguccagccggaucuccaucuacuggaccaucgugaagcccggggacauccugcucaucaacucgaccggcaaccugaucgcgccccgcggguacuucaagauccaguccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaagacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 380 - RNA, 1701 nt, Artificial Sequence
  derived and/or modified CDS sequence (AUadapt) from InfluenzaA__AAY28305__HA
augaaggccaucaucgcccugucguacauccucugccugguguucgcgcagaagcugcccggcaacgacaacuccaccgccacccucugccuggggcaccacgccgucccgaacggcacgcuggugaagaccaucaccaacgaccagaucgaggugaccaacgccacggagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggcguacuccaacugcuaccccuacgacgugccggacuacgucucgcuccgcucccugguggccagcuccggcacccuggaguucaacaacgagucguucaacuggacggggguggcccagaacggcaccuccagcgccugcaagcggcgcuccgacaagucguucuucucccggcucaacuggcugcaccagcugaaguacaaguaccccgcgcucaacgucaccaugcccaacaacgagaaguucgacaagcuguacaucuggggcgugcaccaccccgggaccgacagcgaccagaucucccuguacgcccaggccucggggcgcgugacggucagcaccaagcggucccagcagaccgugaucccgaacaucggcucgggccccugggugcgcggggucuccagccggaucuccaucuacuggaccaucgugaagcccggcgacauccuccugaucaacucgacggggaaccugaucgcgccccgcggcuacuucaagauccgguccggcaagagcuccaucaugcgcucggacgccccgaucgggaagugcaacuccgagugcaucacccccaacggcagcauccccaacgacaagcccuuccagaacgugaaccggaucaccuacggggccugcccgcgcuacgucaagcagaacacccucaagcuggccacgggcaugcggaacgugcccgagaagcagacccgcgggaucuucggcgccaucgccggcuucaucgagaacgggugggagggcaugauggacgggugguacggcuuccggcaccagaacuccgaggggaccggccaggccgcggaccugaaguccacccaggccgccaucaaccagaucaacggcaagcucaaccgccugaucgagaagacgaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacaccaucgaccugaccgacuccgagaugaacaagcuguucgagcgcacgaagaagcagcuccgggagaacgcggaggacaugggcaacgggugcuucaagaucuaccacaagugcgacaacgccugcaucggcagcauccgcaacgggaccuacgaccacgacguguaccgcgacgaggcccugaacaaccgguuccagaucaagggcgucgagcugaaguccggcuacaaggacuggauccucuggaucucguucgccaucagcugcuuccugcugugcaucgugcuccugggguucaucaugugggccugccagaagggcaacauccgcugcaacaucugcaucuga

SEQ ID NO: 381 - RNA, 1701 nt, Artificial Sequence
  derived and/or modified CDS sequence (AUadapt) from InfluenzaA__AAY28325__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcgugaucgucuccaccaagcggucgcagcagaccgugaucccgaacaucggguccggccccugggugcgcggcgucagcucccggaucucgaucuacuggaccaucgugaagcccggggacauccuccugaucaacuccacgggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacccucaagcuggccacggggaugcggaacgugcccgagaagcagacccgcggcaucuucggggccaucgccggcuucaucgagaacggcugggaggggaugauggacggcugguacggguuccggcaccagaacucggagggcaccgggcaggccgccgaccugaaguccacccaggcggccaucaaccagaucaacggcaagcucaaccgccugaucgagaagacgaacgagaaguuccaccagaucgagaaggaguucgccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgggagaacgcggaggacauggggaacggcugcuucaagaucuaccacaagugcgacaacgccugcaucgggucgauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 382 - RNA, 1701 nt, Artificial Sequence
  derived and/or modified CDS sequence (AUadapt) from InfluenzaA__AAY28335__HA
augaagaccaucaucgcccugucguacauccucugccugguguccgcccagaagcugcccggcaacgacaacucgaccgcgacgcucugccuggggcaccacgccgucccgaacggcacccuggugaagaccaucaccaacgaccagaucgaggugacgaacgccaccgagcucguccaguccagcuccaccucgcgcaucugcgacagcccccaccagauccuggacggggagaacugcacccugaucgacgcccuccugggcgacccccacugcgacggguuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccggcguggcccagaacgggaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucgcuguacgcgcaggccuccggccgcgugaccgucagcaccaagcggucccagcagaccgugaucccgaacaucgggucgcgccccugggugcggggcgucuccagccgcaucuccaucuacuggacgaucgugaagcccggcgacauccuccugaucaacucgaccgggaaccugaucgcgccccggggcuacuucaagauccgcuccgggaaguccuccaucaugcggagcgacgccccgaucggcaagugcaacuccgagugcaucacccccaacggcucgauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggcggccaucaaccagaucaacgggaagcugaaccggcugaucgagaagaccaacgagaaguuccaccagaucgagaaggaguucuccgagguggagggccgcauccaggaccuggagaaguacgucgaggacaccaagguggaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaagucgggguacaaggacuggauccuguggaucuccuucgccaucagcugcuuccugcugugcaucguccuccugggcuucaucaugugggccugccagaagggcaacauccggugcaacaucugcaucuga

SEQ ID NO: 383 - RNA, 1701 nt, Artificial Sequence; identical to SEQ ID NO: 277
  derived and/or modified CDS sequence (AUadapt) from InfluenzaA__AAY28345__HA

SEQ ID NO: 384 - RNA, 1701 nt, Artificial Sequence; identical to SEQ ID NO: 317
  derived and/or modified CDS sequence (AUadapt) from InfluenzaA__AAY28355__HA

SEQ ID NO: 385 - RNA, 1701 nt, Artificial Sequence
  derived and/or modified CDS sequence (AUadapt) from InfluenzaA__AAY28363__HA
augaagaccaucaucgcccugucguacauccucugcaugguguucgcccagaagcugcccgucaacgacaacuccaccgcgacgcugugccucggccaccacgccgugccgaacgggacccuggugaagaccaucaccaacgaccacaucgaggucacgaacgccaccgagcuggugcagagcuccucgaccggccgcaucugcgacagcccccaccagauccucgacggggagaacugcacccugaucgacgcccugcucggcgacccccacugcgacggguuccagaacaaggagugggaccuguucguggagcggucgacggccuacuccaacugcuaccccuacgacgucccggacuacgcgagccugcgcucccucguggccagcuccggcacccuggaguucaacaacgagucguucaacuggaccggcguggcccagaacgggaccuccagcgccugcaagcggcgcuccaucaagucguucuucucccggcugaacuggcuccaccagcugaaguacaaguaccccagccugaacgucacgaugcccaacaacgagaaguucgacaagcucuacaucuggggcgugcaccaccccuccaccgacagcgaccagaucucgcuguacgcgcaggccuccgggcgcgugaccgucagcaccaagcggucccagcagacggugaucccgaacaucggcucgcgccccugggugcgcggggucuccagccggaucuccaucuacuggaccaucgugaagcccggcgacauccugcucaucaacucgaccggcaaccugaucgcgccccggggguacuucaagauccgcuccggcaagagcuccaucaugcggagcaacgccccgaucgggaagugcaacuccgagugcaucacccccaacggcucgauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgccgaccugaaguccacccaggcggccaucaaccagaucaacggcaagcugaaccggcucaucgagaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggacccgcaagcagcugcgcgagaacgccgaggacaugggcaacggcugcuucaagaucuaccacaagugcgacaacgcgugcaucgggucgauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcgucgugcugcucggguucaucaugugggccugccagaagggcaacauccgcugcaacaucugcaucuga

SEQ ID NO: 386 - RNA, 1701 nt, Artificial Sequence; identical to SEQ ID NO: 317
  derived and/or modified CDS sequence (AUadapt) from InfluenzaA__AAY28375__HA

SEQ ID NO: 387 - RNA, 1701 nt, Artificial Sequence; identical to SEQ ID NO: 277
  derived and/or modified CDS sequence (AUadapt) from InfluenzaA__AAY28385__HA

SEQ ID NO: 388 - RNA, 1701 nt, Artificial Sequence
  derived and/or modified CDS sequence (AUadapt) from InfluenzaA__AAY28395__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucaaccuguacgcgcaggccuccggccggaucaccgugucgacgaagcgcagccagcagaccgugaucccgaacaucggcucccggccccgcguccgggacgugucgucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacaucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 389 - RNA, 1701 nt, Artificial Sequence
  derived and/or modified CDS sequence (AUadapt) from InfluenzaA__AAY28405__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaucucguccaccgggcgcaucugcgacaacccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucuccaccaagcggagccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccucaagucgacgcaggccgcgaucaaccagaucaacggcaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggucgauccgcaacggcaccuacgaccacgacguguaccgggacgaggcgcugaacaaccgcuuccagaucaagggggucgagcugaaguccggcuacaaggacuggauccucuggaucagcuucgccaucuccugcuuccugcugugcaucgugcuccugggcuucaucaugugggccugccagaaggggaacauccggugcaacaucugcgucuga

SEQ ID NO: 390 - RNA, 1701 nt, Artificial Sequence; identical to SEQ ID NO: 277
  derived and/or modified CDS sequence (AUadapt) from InfluenzaA__AAY28486__HA

SEQ ID NO: 391 - RNA, 1701 nt, Artificial Sequence; identical to SEQ ID NO: 277
  derived and/or modified CDS sequence (AUadapt) from InfluenzaA__AAY28521__HA

SEQ ID NO: 392 - RNA, 1701 nt, Artificial Sequence; identical to SEQ ID NO: 276
  derived and/or modified CDS sequence (AUadapt) from InfluenzaA__AAY28531__HA

SEQ ID NO: 393 - RNA, 1701 nt, Artificial Sequence; identical to SEQ ID NO: 277
  derived and/or modified CDS sequence (AUadapt) from InfluenzaA__AAY28541__HA

SEQ ID NO: 394 - RNA, 1701 nt, Artificial Sequence
  derived and/or modified CDS sequence (AUadapt) from InfluenzaA__AAY28551__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcuccgggcccugggugcgcggcgucagcucccggaucagcaucuacuggaccaucgugaagcccggcgacauccuccugaucaacuccaccgggaaccugaucgcgccccgcggcuacuucaagauccggucggggaaguccagcaucaugcgcuccaacgccccgaucggcaagugcaacucggagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucucggaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaagggcaacauccggugcaacaucugcaucuga

SEQ ID NO: 395 - RNA, 1701 nt, Artificial Sequence; identical to SEQ ID NO: 277
  derived and/or modified CDS sequence (AUadapt) from InfluenzaA__AAY28561__HA

SEQ ID NO: 396 - RNA, 1701 nt, Artificial Sequence; identical to SEQ ID NO: 292
  derived and/or modified CDS sequence (AUadapt) from InfluenzaA__AAY28581__HA

SEQ ID NO: 397 - RNA, 1701 nt, Artificial Sequence
  derived and/or modified CDS sequence (AUadapt) from InfluenzaA__AAY28591__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucgacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 398 - RNA, 1701 nt, Artificial Sequence; identical to SEQ ID NO: 317
  derived and/or modified CDS sequence (AUadapt) from InfluenzaA__AAY28608__HA

SEQ ID NO: 399 - RNA, 1701 nt, Artificial Sequence
  derived and/or modified CDS sequence (AUadapt) from InfluenzaA__AAY28618__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcauguccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaaggggguggagcugaaguccggcuacaaggacuggauccuguggaucucguucgccaucagcugcuuccuccugugcgucgcccugcucggcuucaucaugugggccugccagaaggggaacauccggugcaacaucugcaucuga

SEQ ID NO: 400 - RNA, 1701 nt, Artificial Sequence; identical to SEQ ID NO: 292
  derived and/or modified CDS sequence (AUadapt) from InfluenzaA__AAY28638__HA

SEQ ID NO: 401 - RNA, 1701 nt, Artificial Sequence
  derived and/or modified CDS sequence (AUadapt) from InfluenzaA__AAY28648__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgggccccugggugcgcggggucuccagccggaucuccaucuacuggacgaucgugaagcccggcgacauccuccugaucaacucgaccgggaaccugaucgcgccccgcggcuacuucaagauccgguccggcaagagcuccaucaugcgcucggacgccccgaucgggaagugcaacuccgagugcaucacccccaacggcagcauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggcggccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgcgugcaucggcagcauccgcaacgggaccuacgaccacgacguguaccgcgacgaggcccugaacaaccgguuccagaucaagggcgucgagcugaaguccggcuacaaggacuggauccucuggaucucguucgccaucagcugcuuccugcugugcaucgugcuccugggguucaucaugugggccugccagaagggcaacauccgcugcaacaucugcaucuga

SEQ ID NO: 402 - RNA, 1701 nt, Artificial Sequence
  derived and/or modified CDS sequence (AUadapt) from InfluenzaA__AAY44610__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcaacaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugucgacgaagcgcagccagcagaccgugaucccgaacaucggcucccggccccgcguccgggacgugucgucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 403 - RNA, 1701 nt, Artificial Sequence
  derived and/or modified CDS sequence (AUadapt) from InfluenzaA__AAY44620__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacgagaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggguacaaggacuggauccucuggaucucguucgccaucagcugcuuccugcugugcaucgugcuccugggcuucaucaugugggccugccagaagggcaacauccggugcaacaucugcaucuga

SEQ ID NO: 404 - RNA, 1701 nt, Artificial Sequence; identical to SEQ ID NO: 325
  derived and/or modified CDS sequence (AUadapt) from InfluenzaA__AAY44621__HA

SEQ ID NO: 405 - RNA, 1701 nt, Artificial Sequence; identical to SEQ ID NO: 292
  derived and/or modified CDS sequence (AUadapt) from InfluenzaA__AAY44631__HA

SEQ ID NO: 406 - RNA, 1701 nt, Artificial Sequence
  derived and/or modified CDS sequence (AUadapt) from InfluenzaA__AAY44641__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucucguucgccaucagcugcuuccugcugugcaucggccuccugggguucaucaugugggccugccagaagggcaacauccggugcaacaucugcaucuga

SEQ ID NO: 407 - RNA, 1701 nt, Artificial Sequence
  derived and/or modified CDS sequence (AUadapt) from InfluenzaA__AAY44651__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggagcgcggggugucgucccggaucagcaucuacuggaccaucgucaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcucaaggagaacgcggaggacaugggcaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggguucaucaugugggccugccagaagggcaacauccggugcaacaucugcaucuga

SEQ ID NO: 408 - RNA, 1701 nt, Artificial Sequence
  derived and/or modified CDS sequence (AUadapt) from InfluenzaA__AAY44755__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcgggggcagcagaccgucaucccgaacaucggcagccgccccugggugcggggcguguccucgaucaucuccaucuacuggacgaucgucaagcccggggacauccuccugaucaacagcaccggcaaccugaucgcgccccgcggguacuucaagauccgguccggcaagucguccgugaugcgcagcgacgccuccaucggcaagugcaacucggagugcaucaccccgaacggguccauccccaacgacaagcccuuccagaacgugaaccggaucaccuacggcgccugcccccgcuacgucaagcagaacacgcucaagcuggccaccgggaugcggaacgugccggagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucucggaggucgagggccggauccaggaccuggagaaguacguggaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 409 - RNA, 1701 nt, Artificial Sequence
  derived and/or modified CDS sequence (AUadapt) from InfluenzaA__AAY44775__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccaggacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaccacccucaagcuggccaccgggaugcgcaacgugcccgagaagcagacgcggggcaucuucggggccaucgccggcuucaucgagaacgggugggagggcaugguggacggcugguacggguuccgccaccagaacagcgagggcaccgggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcacguacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 410 - RNA, 1701 nt, Artificial Sequence; identical to SEQ ID NO: 317
  derived and/or modified CDS sequence (AUadapt) from InfluenzaA__AAY44785__HA

SEQ ID NO: 411 - RNA, 1701 nt, Artificial Sequence
  derived and/or modified CDS sequence (AUadapt) from InfluenzaA__AAY44795__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacuccacccaccagauccuggacggggagaacugcacgcugaucgacgcccuccugggcgacccccacugcgacggguuccagaacaaggagugggaccuguucguggagcggagcaccgccuacuccaacugcuaccccuacgacguccccgacuacgcgucgcuccgcucccugguggccagcuccggcacccuggaguucaacaacgagucguucaacuggaccggcguggcccagaacgggacguccagcgccugcaagcggcgcuccaucaagagcuucuucucccggcucaacuggcugcaccagcugaaguacaaguacccggcgcucaacgucaccaugcccaacaacgagaaguucgacaagcuguacaucuggggcgugcaccaccccucgaccgacuccgaccagaucagccuguacgcccaggccucggggcgcgugaccgucuccacgaagcggagccagcagaccgugauccccaacaucggcucccgcccgugggugcgcggggucucgucccggaucagcaucuacuggaccaucgugaagcccggcgacauccuccugaucaacuccaccggcaaccugaucgcgccccggggguacuucaagauccgcagcggcaaguccucgaucaugcgguccaacgcccccaucgggaagugcaacagcgagugcaucacgccgaacggcuccauccccaacgacaagcccuuccagaacgugaaccgcaucaccuacggcgccugcccccgguacgucaagcagaacacccucaagcuggccaccgggaugcgcaacgugccggagaagcagacgcggggcaucuucggggccaucgccggcuucaucgagaacgggugggagggcaugguggacggcugguacggguuccgccaccagaacucggagggcaccgggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacucggagaugaacaagcuguucgagcggacccgcaagcagcuccgcgagaacgcggaggacaugggcaacggcugcuucaagaucuaccacaagugcgacaacgccugcaucggguccauccggaacggcacguacgaccacgacgucuaccgcgacgaggcccugaacaaccgguuccagaucaaggggguggagcucaagagcggcuacaaggacuggauccuguggaucagcuucgccaucuccugcuuccugcugugcgucgugcuccugggguucaucaugugggccugccagaagggcaacauccgcugcaacaucugcaucuga

SEQ ID NO: 412 - RNA, 1701 nt, Artificial Sequence
  derived and/or modified CDS sequence (AUadapt) from InfluenzaA__AAY44796__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccucgaccgggggcaucugcgacagcccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacccuggaguucaacaacgagucguucgacuggaccggcgugacccagaacgggacguccucggccugcaagcgccgguccaacaagagcuucuucucccgccugaacuggcucacccaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucacggugucgaccaagcgcucccagcagaccgugaucccgaacaucggcagccggccccgcguccgggacguguccucgcgcaucuccaucuacuggaccaucgugaagcccggggacauccugcucaucaacucgacgggcaaccugaucgcgccccggggguacuucaagauccgcuccggcaagagcuccaucaugcggucggacgccccgaucggcaagugcaacuccgagugcaucacccccaacgggucgauccccaacgacaagcccuuccagaacgucaaccgcaucaccuacggcgccugcccgcgguacaucaagcagaacacccugaagcucgccacggggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 413 - RNA, 1701 nt, Artificial Sequence; identical to SEQ ID NO: 292
  derived and/or modified CDS sequence (AUadapt) from InfluenzaA__AAY44896__HA

SEQ ID NO: 414 - RNA, 1701 nt, Artificial Sequence
  derived and/or modified CDS sequence (AUadapt) from InfluenzaA__AAY44906__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagcggcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggccugccagaagggcaacauccgcugcaacaucugcaucuga

SEQ ID NO: 415 - RNA, 1701 nt, Artificial Sequence
  derived and/or modified CDS sequence (AUadapt) from InfluenzaA__AAY46371__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccucggaccagaucgaggugacgaacgccaccgagcucguccaguccagcuccaccgggcgcaucugcgacucgccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggucgcuggucgccuccagcggcacgcuggaguucaacaacgaguccuucaacuggaccgggguggcccagaacggcaccucguucgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccgggacggacucggaccagaccucccuguacgcccaggccagcgggcgggugaccgugucgaccaagcgcucccagcagacggucaucccgaacaucggcucgcggcccugggugcgcggcguguccagccggaucuccaucuacuggaccaucgucaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacggcaagcccuuccagaacgugaaccggaucacguacggggccugcccgcgcuacgugaagcagaacacccucaagcuggccaccggcaugcggaacguccccgagaagcagacccgcgggaucuucggcgccaucgccggcuucaucgagaacgggugggagggcaugguggacgggugguacggcuuccggcaccagaacuccgaggggacgggccaggccgcggaccucaagucgacccaggccgccaucaaccagaucaacggcaagcugaaccgccugaucgagaagaccaacgagaaguuccaccagaucgagaaggaguucaccgagguggaggggcggauccaggaccuggagaaguacgucgaggacacgaagaucgaccucugguccuacaacgccgagcugcugguggcccucgagaaccagcacaccaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagucgggcuacaaggacuggauccuguggaucuccuucgccaccagcugcuuccugcugugcgugguccuccugggguucaucaugugggccugccagaagggcaacauccggugcaacaucugcaucuga

SEQ ID NO: 416 - RNA, 1701 nt, Artificial Sequence; identical to SEQ ID NO: 277
  derived and/or modified CDS sequence (AUadapt) from InfluenzaA__AAY46381__HA

SEQ ID NO: 417 - RNA, 1701 nt, Artificial Sequence
  derived and/or modified CDS sequence (AUadapt) from InfluenzaA__AAY46391__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgucgcuccgcucccugguggccagcuccggcacccuggaguucaacaacgagucguucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucagcuccaucaucucgaucuacuggaccaucgugaagcccggcgacauccuccugaucaacuccaccggcaaccugaucgcgccccggggguacuucaagauccggagcggcaaguccucgaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucucggaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 418 - RNA, 1701 nt, Artificial Sequence
  derived and/or modified CDS sequence (AUadapt) from InfluenzaA__AAY46426__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacaagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacauccccgagaagcagacccgggggaucuucggcgccaucgccggguucaucgagaacggcugggagggcauggucgacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaagggcaacauccggugcaacaucugcaucuga

SEQ ID NO: 419 - RNA, 1701 nt, Artificial Sequence
  derived and/or modified CDS sequence (AUadapt) from InfluenzaA__AAY47013__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgggccccugggugcgcggggucuccagccggaucuccaucuacuggacgaucgugaagcccggcgacauccuccugaucaacucgaccgggaaccugaucgcgccccgcggcuacuucaagauccgguccggcaagagcuccaucaugcgcucggacgccccgaucgggaagugcaacuccgagugcaucacccccaacggcagcauccccaacgacaagcccuuccagaacgugaaccggaucaccuacgggccgugcccccgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggccgcgaucaaccagaucaacggcaagcucaaccgccugaucaagaagaccaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcgcugaacaaccgguuccagaucaagggcgucgagcugaaguccggcuacaaggacuggauccucuggaucucguucgccaucagcugcuuccugcugugcaucgugcuccugggguucaucaugugggccugccagaagggcaacauccgcugcaacaucugcaucuga

SEQ ID NO: 420 - RNA, 1701 nt, Artificial Sequence
  derived and/or modified CDS sequence (AUadapt) from InfluenzaA__AAY47023__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggaguggggccuguucguggagcgguccaaggccuacucgaacugcuaccccuacgacgugccggacuacgucucccuccgcagccugguggcguccucgggcacgcuggaguucaacaacgaguccuucaacuggaccgggguggcccagaacggcaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcgggcgcgugaccgucuccaccaagcggucgcagcagaccgugaucccgaacaucggcucccgccccugggugcggggcgucagcucccgcaucucgaucuacuggacgaucgugaagcccggggacauccuccugaucaacuccaccggcaaccugaucgcgccccggggguacuucaagauccgcagcggcaaguccucgaucaugcgguccgacgccccgaucggcaagugcaacagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcaggcccggggcaucuucggggccaucgccggcuucaucgagaacggcugggaggggaugauggacggcugguacggguuccgccaccagaacucggagggcaccgggcaggccgcggaccugaaguccacccaggccgccaucaaccagaucaacggcaagcucaaccggcugaucgagaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacucggagaugaacaagcuguucgagcggacgaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucagcuucgccaucuccugcuuccugcugugcaucgugcuccugggcuucaucaugugggccugccagaaggggaacauccggugcaacaucugcaucuga

SEQ ID NO: 421 - RNA, 1701 nt, Artificial Sequence; identical to SEQ ID NO: 417
  derived and/or modified CDS sequence (AUadapt) from InfluenzaA__AAY47052__HA

SEQ ID NO: 422 - RNA, 1701 nt, Artificial Sequence
  derived and/or modified CDS sequence (AUadapt) from InfluenzaA__AAY47075__HA
augaagaccaucaucgcccugucguacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacccuggaguucaacaacgagucguucaacuggacggggguggcccagaacggcaccuccucggccugcaagcggcgcuccaacaagagcuucuucucccggcucaacuggcugcaccagcugaagaacaaguaccccgcccucaacgucaccaugcccaacaacgagaaguucgacaagcuguacaucuggggcgugcaccaccccgggaccgacucggaccagaucucccuguacgcgcaggccagcgggcgcgugacggucucgaccaagcggucccagcagaccgugaucccgaacaucggcagccgcccccgggugcgcgacaucuccucgcggaucuccaucuacuggaccaucgucaagcccggcgacauccuccugaucaacucgacggggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucaccuacggggccugcccgcgcuacgugaagcagaacacccucaagcuggccacgggcaugcggaacguccccgagaagcagacccgcgggaucuucggcgccaucgccggguucaucgagaacggcugggagggcaugauggacgggugguacggcuuccggcaccagaacuccgaggggaccggccaggccgccgaccucaagagcacccaggcggccaucaaccagaucaacgggaagcugaaccgccugaucgagaagacgaacgagaaguuccaccagaucgagaaggaguucuccgagguggagggccggauccaggaccuggagaaguacguggaggacaccaagaucgaccucuggucguacaacgccgagcugcuggucgcccucgagaaccagcacaccaucgaccugaccgacuccgagaugaacaagcuguucgagcgcacgaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcguggagcugaaguccggguacaaggacuggauccucuggaucucguucgccaucagcugcuuccugcugugcaucguccuccugggcuucaucaugugggccugccagaagggcaacauccgcugcaacaucugcaucuga

SEQ ID NO: 423 - RNA, 1701 nt, Artificial Sequence
  derived and/or modified CDS sequence (AUadapt) from InfluenzaA__AAY47085__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacgucggcucgcggccccgcgugcgggacguguccagccgcaucuccaucuacuggaccaucgucaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaagggggucgagcugaaguccggcuacaaggacuggauccuguggaucucguucgccaucagcugcuuccuccugugcguggcccugcucggcuucaucaugugggccugccagaaggggaacauccggugcaacaucugcaucuga

SEQ ID NO: 424 - RNA, 1701 nt, Artificial Sequence
  derived and/or modified CDS sequence (AUadapt) from InfluenzaA__AAY58320__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacaucuccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 425 - RNA, 1701 nt, Artificial Sequence
  derived and/or modified CDS sequence (AUadapt) from InfluenzaA__AAY59035__HA
augaagaccaucaucgcccugucguacauccucugccugguguucgcccagaagcugaccgucaacgacaacuccacggcgacccucugccugggccaccacgccgugcccaacgggacccuggugaagaccaucacgaacgaccacaucgaggucaccaacgccaccgagcucgugcagagcuccucgaccggccgcaucugcgacuccccgcaccagauccuggacggggagaacugcacgcugaucgacgcccuccugggcgacccccacugcgacggguuccagaacaaggagugggaccuguucguggagcggagcaccgccuacuccaacugcuaccccuacgacguccccgacuacgcgucgcuccgcucccugguggccagcuccggcacccuggaguucaacaacgagucguucaacuggaccggcguggcccagaacgggacguccagcgccugcaagcggcgcuccaucaagagcuucuucucccggcucaacuggcugcaccagcugaaguacaaguacccggcgcucaacgucaccaugcccaacaacgagaaguucgacaagcuguacaucuggggcgugcaccaccccucgaccgacuccgaccagaucagccuguacgcccaggccucggggcgcgugaccgucuccacgaagcggagccagcagaccgugauccccaacaucggcucccgcccgugggugcgcggggucucgucccggaucagcaucuacuggaccaucgugaagcccggcgacauccuccugaucaacuccaccggcaaccugaucgcgccccggggguacuucaagauccgcagcggcaaguccucgaucaugcgguccaacgcccccaucgggaagugcaacagcgagugcaucacgccgaacggcuccauccccaacgacaagcccuuccagaacgugaaccgcaucaccuacggcgccugcccccgguacgucaagcagaacacccucaagcuggccaccgggaugcgcaacgugccggagaagcagacgcggggcaucuucggggccaucgccggcuucaucgagaacgggugggagggcaugguggacggcugguacggguuccgccaccagaacucggagggcaccgggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacucggagaugaacaagcuguucgagcggacccgcaagcagcuccgcgagaacgcggaggacaugggcaacggcugcuucaagaucuaccacaagugcgacaacgccugcaucggguccauccggaacggcacguacgaccacgacgucuaccgcgacgaggcccugaacaaccgguuccagaucaaggggguggagcucaagagcggcuacaaggacuggauccuguggaucagcuucgccaucuccugcuuccugcugugcgucgugcuccugggguucaucaugugggccugccagaagggcaacauccgcugcaacaucugcaucuga

SEQ ID NO: 426 - RNA, 1701 nt, Artificial Sequence
  derived and/or modified CDS sequence (AUadapt) from InfluenzaA__AAY64202__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcgagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagaaccggggcaucuucggggccaucgccggcuucaucgagaacggcugggaggggauggucgacggcugguacggguuccgccaccagaacuccgagggcacggggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcgacaucugcaucuga

SEQ ID NO: 427 - RNA, 1701 nt, Artificial Sequence
  derived and/or modified CDS sequence (AUadapt) from InfluenzaA__AAY64212__HA
augaagaccaucaucgcccugucguacauccucugccugguguucgcccagaagauccccgucaacgacaacuccaccgcgacgcugugccucggccaccacgccgugccgaacgggacccuggugaagaccaucaccaacgagcacaucgaggucacgaacgccaccgagcuggugcagagcuccucgaccggccgcaucugcgacagcccccaccagauccucgacggggagaacugcacccugaucgacgcccugcucggcgacccccacugcgacggguuccagaacaaggagugggaccuguucguggagcggagcacggccuacuccaacugcuaccccuacgacgucccggacuacgcgucgcugcgcucccucguggccagcuccggcacccuggaguucaacaacgagucguucaacuggaccggcguggcccagaacgggaccuccagcgccugcaagcggcgcuccaucaagagcuucuucucccggcugaacuggcuccaccagcugaaguacaaguaccccgcgcugaacgucacgaugcccaacaacgagaaguucgacaagcucuacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucagcucccggaucucgaucuacuggaccaucgugaagcccggcgacauccugcucaucaacuccaccggcaaccugaucgcgccccggggguacuucaagauccgcagcggcaaguccucgaucaugcgguccaacgcccugaucgggaagugcaacagcgagugcaucaccccgaacggcuccauccccaacgacaagcccuuccagaacgugaaccgcaucacguacggcgccugcccccgguacgucaagcagaacacccucaagcuggccaccgggaugcgcaacgugccggagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 428 - RNA, 1701 nt, Artificial Sequence
  derived and/or modified CDS sequence (AUadapt) from InfluenzaA__AAY64222__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaucgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacccuggaguucaacaacgagagcuucaacuggacggggguggcccagaacggcaccuccagcuccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggaccgacuccgaccagaucucgcuguacgcccaggcgagcgggcgcgugacggucuccaccaagcggucgcagcagaccgugaucccgaacaucggcucccgccccugggugcggggcgucagcucccgcaucagcaucuacuggaccaucgugaagcccggggacauccuccugaucaacuccacgggcaaccugaucgcgccccggggguacuucaagauccgcucgggcaaguccagcaucaugcgguccgacgccccgaucggcaagugcaacucggagugcaucacccccaacggguccauccccaacgacaagcccuuccagaacgugaaccgcaucaccuacggcccgugcccccgguacgucaagcagaacacccucaagcuggccacggggaugcgcaacgugcccgagaagcagacccggggcaucuucggggccaucgccggcuucaucgagaacggcugggaggggaugauggacggcugguacggguuccgccaccagaacagcgagggcaccgggcaggccgccgaccugaaguccacccaggccgccaucaaccagaucaacggcaagcucaaccggcugaucgagaagacgaacgagaaguuccaccagaucgagaaggaguucucggagguggagggccgcauccaggaccuggagaaguacgucgaggacaccaagaucgaccucugguccuacaacgcggagcugcugguggcccucgagaaccagcacaccaucgaccugaccgacagcgagaugaacaagcuguucgagaagacgaagaagcagcuccgggagaacgccgaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgcgaucuccugcuuccugcugugcaucgugcuccugggcuucaucaugugggccugccagaaggggaacauccgcugcaacaucugcaucuga

SEQ ID NO: 429 - RNA, 1701 nt, Artificial Sequence
  derived and/or modified CDS sequence (AUadapt) from InfluenzaA__AAY64262__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaugggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 430 - RNA, 1701 nt, Artificial Sequence
  derived and/or modified CDS sequence (AUadapt) from InfluenzaA__AAY64272__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaaggggguggagcugaaguccggcuacaaggacuggauccuguggaucucguucgccaucagcugcuuccuccugugcgucgcccugcucggcuucaucaugugggccugccagaaggggaacauccggugcaacaucugcaucuga

SEQ ID NO: 431 - RNA, 1701 nt, Artificial Sequence
  derived and/or modified CDS sequence (AUadapt) from InfluenzaA__AAY64282__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 432 - RNA, 1701 nt, Artificial Sequence
  derived and/or modified CDS sequence (AUadapt) from InfluenzaA__AAY64292__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgacaagaucugcgacucgccccaccagauccuggacgggggcaacugcacccugaucgacgcccuccugggggacccccacugcgacggcuuccagaacaaggagugggaccuguucguggagcgcucgaaggccuacuccaacugcuaccccuacgacgugccggacuacgucagccuccggucccugguggcgucguccggcacgcuggaguucaacaacgagagcuucaacuggaccgggguggcccagaacggcaccuccucggccugcaagcgccgguccgacaagucguucuucucccgccucaacuggcugcaccagcugaagaacaaguaccccgcccucaacgucaccaugcccaacaacgagaaguucgacaagcuguacaucuggggcgugcaccaccccgggacggacagcgaccagaucucccuguacgcgcaggccucggggcgggugaccgucagcaccaagcgcucccagcagaccgugaucccgaacaucggcucgcggccccgcgugcgggacaucuccucgcgcaucuccaucuacuggacgaucgucaagcccggcgacauccuccugaucaacagcaccgggaaccugaucgcgccccggggcuacuucaagauccgcuccgggaaguccuccaucaugcggucggacgccccgaucggcaagugcaacuccgagugcaucacccccaacggcagcauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacuccgaggggaccggccaggccgccgaccucaagucgacgcaggcggccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggguacaaggacuggauccucuggaucucguucgccaucagcugcuuccugcugugcaucgugcuccugggcuucaucaugugggccugccagaagggcaacauccggugcaacaucugcaucuga

SEQ ID NO: 433 - RNA, 1701 nt, Artificial Sequence
  derived and/or modified CDS sequence (AUadapt) from InfluenzaA__AAY64302__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccucguccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacucgaacugcuaccccuacgacgugccggacuacgcgucccuccggagccuggucgccuccucgggcacgcuggaguucaacaacgaguccuucaacuggaccgggguggcccagaacggcaccagcuucgccugcaagcgccgguccaucaagucguucuucucccgccucaacuggcugcaccagcugaaguacaaguaccccgcgcucaacgugaccaugcccaacaacgacaaguucgacaagcuguacaucuggggcguccaccaccccagcacggacuccgaccagaccucgcuguacgcccaggccagcgggcgggugaccguguccaccaagcgcucgcagcagacggucaucccgaacaucgggucccggcccugggugcgcggcgugagcucccggaucucgaucuacuggaccaucgucaagcccggcgacauccuccugaucaacuccaccgggaaccugaucgcgccccgcggcuacuucaagauccggagcgggaaguccucgaucaugaaguccgacgccccgaucggcaagugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacucggaggggacgggccaggccgcggaccugaaguccacccaggccgccaucaaccagaucaacgggaagcucaaccggcugaucgagaagaccaacgagaaguuccaccagaucgagaaggaguucaccgagguggagggccgcauccaggaccuggagaaguacgucgaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgcggaggacaugggcaacgggugcuucaagaucuaccacaagugcgacaacgugugcaucggcucgauccggaacgggacguacgaccacgacgucuaccgcgacgaggcccugaacaaccgguuccagaucaagggcguggagcugaaguccggguacaaggacuggauccucuggaucagcuucgccaccagcugcuuccugcugugcgucgugcuccugggcuucaucaugugggccugccagaagggcaacauccgcugcaacaucugcaucuga

SEQ ID NO: 434 - RNA, 1701 nt, Artificial Sequence; identical to SEQ ID NO: 428
  derived and/or modified CDS sequence (AUadapt) from InfluenzaA__AAY64312__HA

SEQ ID NO: 435 - RNA, 1701 nt, Artificial Sequence; identical to SEQ ID NO: 431
  derived and/or modified CDS sequence (AUadapt) from InfluenzaA__AAY64322__HA

SEQ ID NO: 436 - RNA, 1701 nt, Artificial Sequence
  derived and/or modified CDS sequence (AUadapt) from InfluenzaA__AAY64332__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgccagccugcggucccucgucgcgucguccgggacccuggaguucaacaacgagagcuucgacuggaccggcgugacccagaacgggacguccucggccugcaagcgccgguccaacaagucguucuucucccgccugaacuggcucacccaccugaaguucaaguaccccgcccugaacgugaccaugcccaacaacgagaaguucgacaagcucuacaucuggggcguccaccaccccgggaccgacagcgaccagaucucccuguacgcccaggcgucgggccggaucacggugagcaccaagcgcucccagcagaccgugaucccgaacaucggcucgcggccccgcguccgggacguguccucgcgcaucuccaucuacuggaccaucgugaagcccggggacauccugcucaucaacagcacgggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggccgcgaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcgacaucugcaucuga

SEQ ID NO: 437 - RNA, 1701 nt, Artificial Sequence
  derived and/or modified CDS sequence (AUadapt) from InfluenzaA__AAY64342__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaccuccugcuuccugcugugcgugguccuccugggcuucaucaugugggccugccagaagggcaacauccggugcaacaucugcaucuga

SEQ ID NO: 438 - RNA, 1701 nt, Artificial Sequence; identical to SEQ ID NO: 277
  derived and/or modified CDS sequence (AUadapt) from InfluenzaA__AAY64352__HA

SEQ ID NO: 439 - RNA, 1701 nt, Artificial Sequence
  derived and/or modified CDS sequence (AUadapt) from InfluenzaA__AAY64362__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucgacuggaccggggugacccagaacggcaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcgggcggaucaccgugucgacgaagcgcucccagcagaccgugaucccgaacaucggcucgcggccccgcguccgggacaucuccagccgcaucuccaucuacuggaccaucgugaagcccggcgacauccugcucaucaacucgaccgggaaccugaucgcgccccggggcuacuucaagauccgcuccgggaaguccuccaucaugcggucggacgccccgaucggcaagugcaacuccgagugcaucacgcccaacggcagcauccccaacgacaagcccuuccagaacgugaaccgcaucaccuacggggccugcccgcgguacaucaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggaccggccaggccgccgaccucaagucgacccaggcggccaucaaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggggucgagcugaaguccggcuacaaggacuggauccuguggaucucguucgccaucagcugcuuccuccugugcguggcccugcucggcuucaucaugugggccugccagaaggggaacauccggugcaacaucugcaucuga

SEQ ID NO: 440 - RNA, 1701 nt, Artificial Sequence; identical to SEQ ID NO: 431
  derived and/or modified CDS sequence (AUadapt) from InfluenzaA__AAY64382__HA

SEQ ID NO: 441 - RNA, 1701 nt, Artificial Sequence
  derived and/or modified CDS sequence (AUadapt) from InfluenzaA__AAY64392__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacaacgaccagaucucgcuguacgcgcaggccuccggccggaucaccgugucgacgaagcgcagccagcagaccgugaucccgaacaucggcucccggccccgcguccgggacgugucgucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 442 - RNA, 1701 nt, Artificial Sequence; identical to SEQ ID NO: 433
  derived and/or modified CDS sequence (AUadapt) from InfluenzaA__AAY64402__HA

SEQ ID NO: 443 - RNA, 1701 nt, Artificial Sequence; identical to SEQ ID NO: 431
  derived and/or modified CDS sequence (AUadapt) from InfluenzaA__AAY98037__HA

SEQ ID NO: 444 - RNA, 1701 nt, Artificial Sequence; identical to SEQ ID NO: 431
  derived and/or modified CDS sequence (AUadapt) from InfluenzaA__AAY98047__HA

SEQ ID NO: 445 - RNA, 1701 nt, Artificial Sequence; identical to SEQ ID NO: 292
  derived and/or modified CDS sequence (AUadapt) from InfluenzaA__AAY98057__HA

SEQ ID NO: 446 - RNA, 1701 nt, Artificial Sequence
  derived and/or modified CDS sequence (AUadapt) from InfluenzaA__AAY98067__HA
augaagaccaucaucgcccugucguacauccucugccugguguucgcccaggagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgggccccugggugcgcggggucuccagccggaucuccaucuacuggacgaucgugaagcccggcgacauccuccugaucaacucgaccgggaaccugaucgcgccccgcggcuacuucaagauccgguccggcaagagcuccaucaugcgcucggacgccccgaucgggaagugcaacuccgagugcaucacccccaacggcagcauccccaacgacaagcccuuccagaacgugaaccggaucaccuacgggccgugcccccgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggccgcgaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcgcugaacaaccgguuccagaucaagggcgucgagcugaaguccggcuacaaggacuggauccucuggaucucguucgccaucagcugcuuccugcugugcaucgugcuccugggguucaucaugugggccugccagaagggcaacauccgcugcaacaucugcaucuga

SEQ ID NO: 447 - RNA, 1701 nt, Artificial Sequence
  derived and/or modified CDS sequence (AUadapt) from InfluenzaA__AAY98077__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucggccucccgcaucugcgacagcccccaccagauccuggacggggagaacugcacccugaucgacgcccuccugggcgacccccacugcgacggguuccagaacaaggagugggaccuguucguggagcgguccaaggcguacucgaacugcuaccccuacgacgugccggacuacgucucccuccgcagccugguggccuccucgggcacccuggaguucaacaacgaguccuucaacuggacgggcguggcccagaacgggaccagcuccgccugcaagcggcgcucggacaaguccuucuucagccggcucaacuggcugcaccagcugaaguacaaguaccccgcgcucaacgucaccaugcccaacaacgagaaguucgacaagcuguacaucuggggcgugcaccaccccgggaccgacuccgaccagaucucgcuguacgcccaggccagcggccgcgugacggucuccaccaagcggucgcagcagaccgugaucccgaacaucgggucccgccccugggugcggggcgucagcucccgcaucucgaucuacuggaccaucgugaagcccggcgacauccuccugaucaacuccacggggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggguucaucgagaacggcugggagggcaugauggacgggugguacggcuuccgccaccagaacucggaggggaccggccaggccgcggaccugaaguccacccaggccgccaucaaccagaucaacgggaagcucaaccggcugaucgagaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacucggagaugaacaagcuguucgagcggacgaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcaucgugcuccugggcuucaucaugugggccugccagaagggcaacauccggugcaacaucugcaucuga

SEQ ID NO: 448 - RNA, 1701 nt, Artificial Sequence
  derived and/or modified CDS sequence (AUadapt) from InfluenzaA__AAY98087__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccgggguggcccagaacggcaccuccagcgccugcaagcgccgguccaucaagucguucuucucccgccucaacuggcugcaccagcugaaguacaaguaccccgcgcucaacgugaccaugcccaacaacgacaaguucgacaagcuguacaucuggggcguccaccaccccagcacggacuccgaccagaccucgcuguacgcccaggccagcgggcgggugaccguguccaccaagcgcucgcagcagacggucaucccgaacaucgggucccggcccugggugcgcggcgugagcucccggaucucgaucuacuggaccaucgucaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacucggaggggacgggccaggccgcggaccugaaguccacccaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacucggagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 449 - RNA, 1701 nt, Artificial Sequence; identical to SEQ ID NO: 431
  derived and/or modified CDS sequence (AUadapt) from InfluenzaA__AAY98097__HA

SEQ ID NO: 450 - RNA, 1701 nt, Artificial Sequence; identical to SEQ ID NO: 431
  derived and/or modified CDS sequence (AUadapt) from InfluenzaA__AAY98107__HA

SEQ ID NO: 451 - RNA, 1701 nt, Artificial Sequence
  derived and/or modified CDS sequence (AUadapt) from InfluenzaA__AAY98117__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggggguccaacaagucguucuucucccgccucaacuggcugcaccagcugaaguacaaguaccccgcgcucaacgugaccaugcccaacaacgagaaguucgagaagcuguacaucuggggcguccaccaccccagcacggacuccgaccagaucucgcuguacgcccaggccagcgggcgggugaccguguccaccaagcgcucgcagcagaccgucaucccgaacaucggcucccggcccugggugcgcggcgugagcucccggaucucgaucuacuggacgaucgucaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacucggagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 452 - RNA, 1701 nt, Artificial Sequence; identical to SEQ ID NO: 431
  derived and/or modified CDS sequence (AUadapt) from InfluenzaA__AAY98147__HA

SEQ ID NO: 453 - RNA, 1701 nt, Artificial Sequence; identical to SEQ ID NO: 431
  derived and/or modified CDS sequence (AUadapt) from InfluenzaA__AAY98157__HA

SEQ ID NO: 454 - RNA, 1701 nt, Artificial Sequence
  derived and/or modified CDS sequence (AUadapt) from InfluenzaA__AAY98167__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccacccagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 455 - RNA, 1701 nt, Artificial Sequence
  derived and/or modified CDS sequence (AUadapt) from InfluenzaA__AAY98177__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccggccugcugguggcccucgagaaccagcacaccaucgaccugacggacucggagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 456 - RNA, 1701 nt, Artificial Sequence
  derived and/or modified CDS sequence (AUadapt) from InfluenzaA__AAY98195__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 457 - RNA, 1701 nt, Artificial Sequence; identical to SEQ ID NO: 431
  derived and/or modified CDS sequence (AUadapt) from InfluenzaA__AAY98207__HA

SEQ ID NO: 458 - RNA, 1701 nt, Artificial Sequence; identical to SEQ ID NO: 433
  derived and/or modified CDS sequence (AUadapt) from InfluenzaA__AAY98217__HA

SEQ ID NO: 459 - RNA, 1701 nt, Artificial Sequence; identical to SEQ ID NO: 431
  derived and/or modified CDS sequence (AUadapt) from InfluenzaA__AAY98227__HA

SEQ ID NO: 460 - RNA, 1701 nt, Artificial Sequence; identical to SEQ ID NO: 431
  derived and/or modified CDS sequence (AUadapt) from InfluenzaA__AAY98237__HA

SEQ ID NO: 461 - RNA, 1701 nt, Artificial Sequence
  derived and/or modified CDS sequence (AUadapt) from InfluenzaA__AAY98247__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacaucaagcagaacacgcucaagcuggccaccggcaugcgcaacgugcccgagaagcagacccgggggaucuucggcgccaucgccggguucaucgagaacggcugggagggcauggucgacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaagggcaacauccggugcaacaucugcaucuga

SEQ ID NO: 462 - RNA, 1701 nt, Artificial Sequence; identical to SEQ ID NO: 431
  derived and/or modified CDS sequence (AUadapt) from InfluenzaA__AAY98319__HA

SEQ ID NO: 463 - RNA, 1701 nt, Artificial Sequence
  derived and/or modified CDS sequence (AUadapt) from InfluenzaA__AAY98329__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggcccucgggcgcgugaccgugucgaccaagcggucccagcagaccgucaucccgaacaucgggagccgccccugggugcggggcguguccucgcgcaucuccaucuacuggacgaucgucaagcccggcgacauccugcugaucaacagcaccgggaaccucaucgcgccccggggcuacuucaagauccgcuccgggaaguccuccaucaugcggucggacgccccgaucggcaagugcaacuccgagugcaucacccccaacggcagcauccccaacgacaagcccuuccagaacgugaaccgcaucaccuacggggccugcccgcgguacgugaagcagaacacgcugaagcuggccaccggcaugcgcaacguccccgagaagcagacccgggggaucuucggcgccaucgccggguucaucgagaacggcugggagggcaugguggacgggugguacggcuuccgccaccucaacuccgaggggaccggccaggccgcggaccucaagucgacgcaggccgccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggaccaagaagcagcugcgcgagaacgcggaggacaugggcaacgggugcuucaagaucuaccacaagugcgacaacgccugcaucggcucgauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 464 - RNA, 1701 nt, Artificial Sequence; identical to SEQ ID NO: 431
  derived and/or modified CDS sequence (AUadapt) from InfluenzaA__AAY98339__HA

SEQ ID NO: 465 - RNA, 1701 nt, Artificial Sequence; identical to SEQ ID NO: 431
  derived and/or modified CDS sequence (AUadapt) from InfluenzaA__AAY98353__HA

SEQ ID NO: 466 - RNA, 1701 nt, Artificial Sequence
  derived and/or modified CDS sequence (AUadapt) from InfluenzaA__AAY98366__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccucggaccagaucgaggugacgaacgccaccgagcucguccaguccagcuccaccgggcgcaucugcgacucgccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggucgcuggucgccuccagcggcacgcuggaguucaacaacgaguccuucaacuggaccgggguggcccagaacggcaccucguucgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccgggacggacucggaccagaccucccuguacgcccaggccagcgggcgggugaccgugucgaccaagcgcucccagcagacggucaucccgaacaucggcucgcggcccugggugcgcggcguguccagccggaucuccaucuacuggaccaucgucaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucacguacggcgccugcccgcgcuacgugaagcagaacacccucaagcuggccaccgggaugcggaacguccccgagaagcagacccgcggcaucuucggggccaucgccggcuucaucgagaacggcugggaggggaugguggacggcugguacggguuccggcaccagaacuccgagggcacggggcaggccgcggaccucaagucgacccaggccgccaucaaccagaucaacggcaagcugaaccgccugaucgagaagaccaacgagaaguuccaccagaucgagaaggaguucaccgagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagcgcacccgcaagcagcuccgggagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagucgggcuacaaggacuggauccuguggaucuccuucgccaccagcugcuuccugcugugcgugguccuccugggcuucaucaugugggccugccagaaggggaacauccggugcaacaucugcaucuga

SEQ ID NO: 467 - RNA, 1701 nt, Artificial Sequence
  derived and/or modified CDS sequence (AUadapt) from InfluenzaA__AAY98376__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaucaagucguucuucucccggcucaacuggcugcaccagcugaaguacaaguaccccgcgcucaacgugaccaugcccaacaacgacaaguucgacaagcuguacaucuggggcguccaccaccccagcacggacuccgaccagaccucgcuguacgcccaggccagcgggcgcgugaccguguccaccaagcggucgcagcagacggucaucccgaacaucgggucccgccccugggugcggggcgugagcucccgcaucucgaucuacuggaccaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacucggaggggacgggccaggccgcggaccugaaguccacccaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacacgaucgaccugaccgacucggagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 468 - RNA, 1701 nt, Artificial Sequence
  derived and/or modified CDS sequence (AUadapt) from InfluenzaA__AAY98386__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgggaacugcacccugaucgacgcccuccugggcgacccccacugcgacggcuuccagaacaaggagugggaccuguucguggagcggucgaagguguacuccaacugcuaccccuacgacgucccggacuacgccagccuccgcucccugguggcgucguccgggacgcuggaguucaacaacgagagcuucaacuggaccggcguggcccagaacgggaccuccagcgccugcaagcggcgcuccaucaagucguucuucucccggcucaacuggcugcaccagcugaaguacaaguaccccgcccucaacgucaccaugcccaacaacgagaaguucgacaagcuguacaucuggggcgugcaccaccccagcacggacuccgaccagaucucgcuguacgcgcaggccagcgggcgcgugaccgucuccaccaagcggucgcagcagaccgugaucccgaacaucggcucccgccccugggugcggggcgucagcucccgcaucagcaucuacuggacgaucgugaagcccggggacauccuccugaucaacuccaccggcaaccugaucgcgccccggggguacuucaagauccgcucgggcaaguccagcaucaugcgguccgacgccccgaucggcaagugcaacucggagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugguggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucucggaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggcuucaucaugugggccugccagaaggggaacauccggugcaacaucugcaucuga

SEQ ID NO: 469 - RNA, 1701 nt, Artificial Sequence; identical to SEQ ID NO: 431
  derived and/or modified CDS sequence (AUadapt) from InfluenzaA__AAY98396__HA

SEQ ID NO: 470 - RNA, 1701 nt, Artificial Sequence; identical to SEQ ID NO: 431
  derived and/or modified CDS sequence (AUadapt) from InfluenzaA__AAY98406__HA

SEQ ID NO: 471 - RNA, 1701 nt, Artificial Sequence
  derived and/or modified CDS sequence (AUadapt) from InfluenzaA__AAZ32946__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucggaggccuacuccaacugcuaccccuacgacgugccggacuacgcgagccugcggucccucaucgccucguccgggacgcuggaguucaccaacgagagcuucaacuggaccggcgucacccagaacgggacguccucggccugcaagcgccgguccaacaagucguucuucucccgccugaacuggcucacccaccugaaguacaaguaccccgcccugaacgugaccaugcccaacaacgagaaguucgacaagcucuacaucuggggcgugcaccaccccgggaccgacagcgaccagaucucccuguacgcgcaggccucgggccggaucacggucagcaccaagcgcucccagcagaccgugaucccgaacaucggcucgcggccccgcgugcgggacgucuccucgcgcaucuccaucuacuggaccaucgugaagcccggggacauccugcucaucaacagcacgggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacaucaaccgcaucaccuacgggaccugcccgcgguacgugaagcagaacacgcugaagcucgccaccggcaugcgcaacguccccgagaagcagacccggggcaucuucggggccaucgccggcuucaucgagaacggcugggaggggaugguggacggcugguacggguuccgccaccagaacuccgagggcaccgggcaggccgccgaccugaaguccacgcaggccgcgaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacaccaucgaccucacggacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcgucgagcugaaguccggcuacaaggacuggauccuguggaucucguucgccaucagcugcuuccuccugugcguggugcugcucggguucaucaugugggccugccagaagggcaacauccggugcaacaucugcaucuga

SEQ ID NO: 472 - RNA, 1701 nt, Artificial Sequence
  derived and/or modified CDS sequence (AUadapt) from InfluenzaA__AAZ32949__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucggaggccuacuccaacugcuaccccuacgacgugccggacuacgcgagccugcggucccucaucgccucguccgggacgcuggaguucaccaacgagagcuucaacuggaccggcgucacccagaacgggacguccucggccugcaagcgccgguccaacaagucguucuucucccgccugaacuggcucacccaccugaaguacaaguaccccgcccugaacgugaccaugcccaacaacgagaaguucgacaagcucuacaucuggggcgugcaccaccccgggaccgacagcgaccagaucucccuguacgcgcaggccucgggccggaucacggucagcaccaagcgcucccagcagaccgugaucccgaacaucggcucgcggccccgcgugcgggacaucuccucgcgcaucuccaucuacuggaccaucgucaagcccggggacauccugcucaucaacagcacgggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacaucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucucguucgccaucagcugcuuccuccugugcgucgugcugcucggguucaucaugugggccugccagaagggcaacauccggugcaacaucugcaucuga

SEQ ID NO: 473 - RNA, 1701 nt, Artificial Sequence
  derived and/or modified CDS sequence (AUadapt) from InfluenzaA__AAZ32950__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucggaggccuacuccaacugcuaccccuacgacgugccggacuacgcgagccugcggucccucaucgccucguccgggacgcuggaguucaccaacgagagcuucaacuggaccggcgucacccagaacgggacguccucggccugcaagcgccgguccaacaagucguucuucucccgccugaacuggcucacccaccugaaguacaaguaccccgcccugaacgugaccaugcccaacaacgagaaguucgacaagcucuacaucuggggcgugcaccaccccgggaccgacagcgaccagaucucccuguacgcgcaggccucgggccggaucacggucagcaccaagcgcucccagcagaccgugaucccgaacaucggcucgcggccccgcgugcgggacgucuccucgcgcaucuccaucuacuggaccaucgugaagcccggggacauccugcucaucaacagcacgggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacaucaaccgcaucaccuacggcgccugcccgcgguacgugaagcagaacacccugaagcucgccacggggaugcgcaacguccccgagaagcagacccggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacaccaucgaccucaccgacuccgagaugaacaagcuguucgagcggacgaaggagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucucguucgccaucagcugcuuccuccugugcguggugcugcucggguucaucaugugggccugccagaagggcaacauccggugcaacaucugcaucuga

SEQ ID NO: 474 - RNA, 1701 nt, Artificial Sequence
  derived and/or modified CDS sequence (AUadapt) from InfluenzaA__AAZ32951__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccacugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcuccaccagcugaaguacaaguaccccgcccugaacguggcgaugcccaacaacgagaaguucgacaagcucuacaucuggggcguccaccaccccgggacggacucggaccagaucucccuguacgcccaggccagcggccggaucaccgugucgaccaagcgcucccagcagaccgugaucccgaacaucggcucgcggccccgcguccgggacaucuccagccgcaucuccaucuacuggacgaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgcggaccugaaguccacgcaggccgccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggucguacaacgccgagcuccugguggcccuggagaaccagcacaccaucgaccucacggacuccgagaugaacaagcuguucgagcggaccaagaagcagcugcgcgagaacgcggaggacaugggcaacgggugcuucaagaucuaccacaagugcgacaacgccugcaucggcagcauccgcaacgggaccuacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggcgugccagaagggcaacauccggugcaacaucugcaucuga

SEQ ID NO: 475 - RNA, 1701 nt, Artificial Sequence
  derived and/or modified CDS sequence (AUadapt) from InfluenzaA__AAZ32952__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccacugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcuccaccagcugaaguacaaguaccccgcccugaacguggcgaugcccaacaacgagaaguucgacaagcucuacaucuggggcguccaccaccccgggacggacucggaccagaucucccuguacgcccaggccagcggccggaucaccgugucgaccaagcgcucccagcagaccgugaucccgaacaucggcucgcggccccgcguccgggacguguccagccgcaucuccaucuacuggacgaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgucaacaagaucaccuacggcgccugcccgcgcuacgugaagcagaacacgcugaagcucgccaccgggaugcggaacgugcccgagaagcagacccgcggcaucuucggggccaucgccggcuucaucgagaacggcugggaggggauggucgacggcugguacggguuccggcaccagaacuccgagggcaccgggcaggccgcggaccugaaguccacgcaggccgccaucaaccagaucaacggcaagcugaaccgccucaucggcaagaccaacgagaaguuccaccagaucgagaaggaguucuccgagguggaggggcggauccaggaccuggagaaguacguggaggacaccaagaucgaccuguggucguacaacgccgagcuccuggucgcccuggagaaccagcacaccaucgaccucacggacuccgagaugaacaagcuguucgagcgcaccaagaagcagcugcgggagaacgcggaggacaugggcaacgggugcuucaagaucuaccacaagugcgacaacgccugcaucggcagcauccgcaacgggaccuacgaccacgacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggcgugccagaagggcaacauccgcugcaacaucugcaucuga

SEQ ID NO: 476 - RNA, 1701 nt, Artificial Sequence
  derived and/or modified CDS sequence (AUadapt) from InfluenzaA__AAZ32953__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccacugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcuccaccagcugaaguacaaguaccccgcccugaacguggcgaugcccaacaacgagaaguucgacaagcucuacaucuggggcguccaccaccccgggacggacucggaccagaucucccuguacgcccaggccagcggccggaucaccgugucgaccaagcgcucccagcagaccgugaucccgaacaucggcucgcggccccgcguccgggacguguccagccgcaucuccaucuacuggacgaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgucaaccgcaucaccuacggcgccugcccgcgguacgugaagcagaacacgcugaagcucgccaccgggaugcgcaacgugcccgagaagcagacccggggcaucuucggggccaucgccggcuucaucgagaacggcugggaggggauggucgacggcugguacggguuccgccaccagaacuccgagggcaccgggcaggccgcggaccugaaguccacgcaggccgccaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucacggacuccgagaugaacaagcuguucgagcggaccaagaagcagcugcgcgagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggcgugccagaagggcaacauccggugcaacaucugcaucuga

SEQ ID NO: 477 - RNA, 1701 nt, Artificial Sequence
  derived and/or modified CDS sequence (AUadapt) from InfluenzaA__AAZ38462__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccucguccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacucgaacugcuaccccuacgacgugccggacuacgcgucccuccggagccuggucgccuccucgggcacgcuggaguucaacaacgaguccuucaacuggaccgggguggcccagaacggcaccagcuucgccugcaagcgccgguccaucaagucguucuucucccgccucaacuggcugcaccagcugaaguacaaguaccccgcgcucaacgugaccaugcccaacaacgacaaguucgacaagcuguacaucuggggcguccacuaccccgggacggacagcgaccagaccucccuguacgcccaggccucggggcgggugaccgugagcaccaagcgcucccagcagacggucaucccgaacaucggcucgcggcccugggugcgcggcguguccagccggaucuccaucuacuggaccaucgucaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacggcaagcccuuccagaacgugaaccggaucacguacggggccugcccgcgcuacgugaagcagaacacccucaagcuggccaccggcaugcggaacguccccgagaagcagacccgcgggaucuucggcgccaucgccggcuucaucgagaacgggugggagggcaugguggacgggugguacggcuuccggcaccagaacuccgaggggacgggccaggccgcggaccucaagucgacccaggccgccaucaaccagaucaacggcaagcugaaccgccugaucgagaagaccaacgagaaguuccaccagaucgagaaggaguucaccgagguggaggggcggauccaggaccuggagaaguacgucgaggacacgaagaucgaccucugguccuacaacgccgagcugcugguggcccucgagaaccagcacaccaucgaccugaccgacagcgagaugaacaagcuguucgagcgcacccgccggcagcuccgcgagaacgcggaggacaugggcaacgggugcuucaagaucuaccacaagugcgacaacgccugcaucggcuccauccggaacgggacguacgaccacgacguguaccgcgacgaggcccugaacaaccgguuccagaucaagggcgucgagcucaagucgggcuacaaggacuggauccuguggaucuccuucgccaccagcugcuuccugcugugcgugguccuccugggguucaucaugugggccugccagaagggcaacauccgcugcaacaucugcaucuga

SEQ ID NO: 478 - RNA, 1701 nt, Artificial Sequence
  derived and/or modified CDS sequence (AUadapt) from InfluenzaA__AAZ38473__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccucguccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacucgaacugcuaccccuacgacgugccggacuacgcgucccuccggagccuggucgccuccucgggcacgcuggaguucaacaacgaguccuucaacuggaccgggguggcccagaacggcaccagcuucacgugcaagcgccgguccaucaagucguucuucucccgccucaacuggcugcaccagcugaaguacaaguaccccgcccucaacgugaccaugcccaacaacgacaaguucgacaagcuguacaucuggggcguccaccaccccagcaccgacuccgaccagaccucgcuguacgcgcaggccagcgggcgggugaccguguccacgaagcgcucgcagcagaccgucaucccgaacaucgggucccggcccugggugcgcggcgugagcucccggaucucgaucuacuggaccaucgucaagcccggcgacauccuccugaucaacuccaccgggaaccugaucgcgccccgcggcuacuucaagauccggagcgggaaguccucgaucaugaaguccgacgccccgaucggcaagugcaacagcgagugcaucacgcccaacggcuccauccccaacgacaagcccuuccagaacgugaaccgcaucaccuacggggccugcccgcgguacgugaagcagaacacccucaagcuggccaccggcaugcgcaacguccccgagaagcagacgcgggggaucuucggcgccaucgccggguucaucgagaacggcugggagggcaugguggacgggugguacggcuuccgccaccagaacucggaggggaccggccaggccgccgaccugaaguccacccaggcggccaucaaccagaucaacgggaagcucaaccggcugaucgagaagaccaacgagaaguuccaccagaucgagaaggaguucacggagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagcggacgcgcaagcagcuccgcgagaacgccgaggacaugggcaacgggugcuucaagaucuaccacaagugcgacaacgugugcaucggcucgauccggaacgggaccuacgaccacgacgucuaccgcgacgaggcgcugaacaaccgguuccagaucaagggcguggagcugaaguccggguacaaggacuggauccucuggaucagcuucgccaccagcugcuuccugcugugcgucgugcuccugggcuucaucaugugggccugccagaagggcaacauccgcugcaacaucugcaucuga

SEQ ID NO: 479 - RNA, 1701 nt, Artificial Sequence; identical to SEQ ID NO: 431
  derived and/or modified CDS sequence (AUadapt) from InfluenzaA__AAZ38484__HA

SEQ ID NO: 480 - RNA, 1701 nt, Artificial Sequence
  derived and/or modified CDS sequence (AUadapt) from InfluenzaA__AAZ38495__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcuccaagaucucgaucuacuggacgaucgucaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacucggaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 481 - RNA, 1701 nt, Artificial Sequence
  derived and/or modified CDS sequence (AUadapt) from InfluenzaA__AAZ38517__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcaacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 482 - RNA, 1701 nt, Artificial Sequence
  derived and/or modified CDS sequence (AUadapt) from InfluenzaA__AAZ38539__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgaagaucuccaucuacuggacgaucgugaagcccggggacaucuuccucaucaacagcaccggcaaccugaucgcgccccgcggguacuucaagauccgguccggcaagucguccaucaugcgcagcgacgccccgaucggcaagugcaacuccgagugcaucacccccaacgggucgauccccaacgacaagcccuuccagaacgugaaccggaucaccuacggcccgugcccccgcuacgucaagcagaacacgcugaagcucgccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagcgcaccaagaagcagcugcgggagaacgccgaggacauggggaacggcugcuucaagaucuaccacaagugcgacaacgccugcaucgggucgauccgcaacggcaccuacgaccacgacguguaccgcgacgaggcgcucaacaaccgguuccagaucaagggggucgagcugaaguccggcuacaaggacuggauccuguggaucagcuucgccaucagcugcuuccuccugugcaucgugcugcucggcuucaucaugugggccugccagaaggggaacauccgcugcaacaucugcaucuga

SEQ ID NO: 483 - RNA, 1701 nt, Artificial Sequence; identical to SEQ ID NO: 431
  derived and/or modified CDS sequence (AUadapt) from InfluenzaA__AAZ38561__HA

SEQ ID NO: 484 - RNA, 1701 nt, Artificial Sequence
  derived and/or modified CDS sequence (AUadapt) from InfluenzaA__AAZ38583__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccuggucgccagcuccgggacgcucgaguucaacaacgagucguucaacuggaccggcgugacccagaacgggaccuccagcgccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccaacaacgaccagaucucgcucuacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcugaucaacagcaccggcaaccucaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagucgacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggaucaucuggaucagcuucgccaucuccugcuuccugcugugcguggcccuccugggguucaucaugugggccugccagaagggcaacauccggugcaacaucugcaucuga

SEQ ID NO: 485 - RNA, 1701 nt, Artificial Sequence
  derived and/or modified CDS sequence (AUadapt) from InfluenzaA__AAZ38594__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagagcuucaacuggaccggcgugacccagaacgggaccuccucggccugcaagcgccgguccaacagcuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcgcaggccucgggccggaucaccgugagcacgaagcgcucccagcagaccgugaucccgaacaucggcucgcggccccgcguccgggacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 486 - RNA, 1701 nt, Artificial Sequence
  derived and/or modified CDS sequence (AUadapt) from InfluenzaA__AAZ38605__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgccagccugcggucccucgucgcgucguccgggacccuggaguucaacaacgagucguucaacuggaccggcgugacccagaacgggacguccagcgccugcaagcgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcccaggcguccggccggaucacggugucgaccaagcgcucgcagcagaccgugaucccguccaucggcagccggccccgcauccgggacguccccucccgcaucucgaucuacuggaccaucgugaagcccggggacauccugcucaucaacuccacgggcaaccugaucgccccgcggggguacuucaagauccgcucgggcaaguccagcaucaugcgguccgacgcccccaucggcaagugcaacucggagugcaucacccccaacggguccauccccaacgacaagccguuccagaacgugaaccgcaucaccuacggcgccugcccccgguacgucaagcagaacacccugaagcucgccacggggaugcgcaacgugcccgagaagcagacccggggcaucuucggggcgaucgccggcuucaucgagaacggcugggaggggaugguggacggcugguacggguuccgccaccagaacucggagggcaccgggcaggccgccgaccugaaguccacccaggccgcgaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgccugcaucggcuccauccgcaacgggaccuacgaccacgacgucuaccgggacgaggcgcucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 487 - RNA, 1698 nt, Artificial Sequence
  derived and/or modified CDS sequence (AUadapt) from InfluenzaA__AAZ38627__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugucggucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcucggccaagcugcggauggccaccggccuccgcaacauccccuccauccagagccgggggcuguucggcgccaucgcgggcuucaucgagggcggguggaccgggauggucgacggcugguacggguaccaccaccagaacgagcagggcuccggcuacgccgccgaccagaaguccacccagaacgccaucaacgggaucaccaacaaggugaacagcgugaucgagaagaugaacacccaguucacggccgucggcaaggaguucaacaagcuggagcgccggauggagaaccucaacaagaagguggacgacggguuccuggacaucuggaccuacaacgcggagcugcucguccugcuggagaacgagcgcacccucgacuuccacgacagcaacgugaagaaccuguacgagaaggugaagucccagcugaagaacaacgccaaggagaucggcaacgggugcuucgaguucuaccacaagugcaacaacgagugcauggagagcgucaagaacggcaccuacgacuaccccaaguacuccgaggagucgaagcucaaccgggagaagaucgacggcgugaagcuggaguccauggggguguaccagauccuggccaucuacagcacggucgccagcucccucgugcugcuggugagccucggcgccaucuccuucuggaugugcagcaacgggucccugcagugccgcaucugcaucuga

SEQ ID NO: 488 - RNA, 1701 nt, Artificial Sequence
  derived and/or modified CDS sequence (AUadapt) from InfluenzaA__AAZ38638__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 489 - RNA, 1701 nt, Artificial Sequence; identical to SEQ ID NO: 488
  derived and/or modified CDS sequence (AUadapt) from InfluenzaA__AAZ38650__HA

SEQ ID NO: 490 - RNA, 1701 nt, Artificial Sequence
  derived and/or modified CDS sequence (AUadapt) from InfluenzaA__AAZ43370__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucaucgagcgcagcaaggccuucuccaacugcuaccccuacgacgugccggacuacgcgucgcugcggucccucguggccagcuccggcacgcuggaguucaucaacgagggguucaacuggaccggcgucacccagagcgggggcuccuacgccugcaagcgcgggucggugaaguccuucuucagccggcugaacuggcucuacgaguccgaguacaaguaccccgcccugaacgugaccaugcccaacaacggcaaguucgacaagcuguacaucuggggcguccaccaccccagcacggagaaggagcagaccaaccucuacgugcgcgcguccgggcgggugaccgucucgaccaagcgcagccagcagacggugaucccgaacaucggcucccggcccugggugcgcgggcugucgucccggaucagcaucuacuggaccaucgucaagcccggcgacauccugcucaucaacuccaccggcaaccugaucgcgccccgcggguacuucaagauccggaccggcaagagcuccaucaugcgcucggacgccccgaucgggacgugcuccagcgagugcaucacccccaacggcuccauccccaacgacaagcccuuccagaacgugaacaagaucaccuacggggccugcccgcgguacgugaagcagaacacccugaagcucgccacgggcaugcgcaacguccccgagaagcagacccggggcaucuucggggccaucgccggcuucaucgagaacgggugggagggcaugguggacgggugguacggcuuccgccaccagaacagcgagggcaccgggcaggccgccgaccugaaguccacccaggccgcgaucgaccagaucaacggcaagcugaaccggcucaucgagaagacgaacgagaaguuccaccagaucgagaaggaguucucggagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgcggaagcagcugcgcgagaacgccgaggacaugggcaacgggugcuucaagaucuaccacaagugcgacaacgccugcaucggcuccauccgcaacggcaccuacgaccacgacguguaccgggacgaggcgcucaacaaccgcuuccagaucaagggggucgagcugaaguccggcuacaaggacuggauccuguggaucuccuucgccaucagcugcuuccuccugugcgugguccugcucggguucaucaugugggccugccagaagggcaacauccggugcaacaucugcaucuga

SEQ ID NO: 491 - RNA, 1701 nt, Artificial Sequence; identical to SEQ ID NO: 363
  derived and/or modified CDS sequence (AUadapt) from InfluenzaA__AAZ43394__HA

SEQ ID NO: 492 - RNA, 1701 nt, Artificial Sequence
  derived and/or modified CDS sequence (AUadapt) from InfluenzaA__AAZ43405__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucagcaucuacuggacgaucgucaagcccggcgacauccuccugaucaacugcaccgggaaccugaucgcgccccggggcuacuucaagauccgcuccgggaaguccuccaucaugcggucggacgccuccaucggcaagugcaacagcgagugcaucaccccgaacggcuccauccccaacgacaagcccuuccagaacgugaaccgcaucaccuacggggccugcccccgguacgugaagcagaacacgcucaagcuggccaccggcaugcgcaacgucccggagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcgugguccuccugggcuucaucaugugggccugccagaagggcaacauccggugcaacaucugcaucuga

SEQ ID NO: 493 - RNA, 1701 nt, Artificial Sequence; identical to SEQ ID NO: 292
  derived and/or modified CDS sequence (AUadapt) from InfluenzaA__AAZ74352__HA

SEQ ID NO: 494 - RNA, 1701 nt, Artificial Sequence; identical to SEQ ID NO: 448
  derived and/or modified CDS sequence (AUadapt) from InfluenzaA__AAZ74363__HA

SEQ ID NO: 495 - RNA, 1698 nt, Artificial Sequence
  derived and/or modified CDS sequence (AUadapt) from InfluenzaA__AAZ74374__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccucgguguccagcuucgagcgguucgagaucuucccgaaggaguccagcuggcccaaccacacggugaccggggucuccgccagcugcucccacaacggcaagucguccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacggccgccgguucacccccgagaucaccaagcgccccaagguccgggaccaggaggggcgcaucaacuacuacuggacccuccuggagcccggcgacacgaucaucuucgaggccaacgggaaccugaucgcgccgugguacgccuucgcccucucgcggggcuucggcuccgggaucaucaccagcaacgcccccauggacgagugcgacgccaagugccagacgccccagggcgcgaucaacuccagccugcccuuccagaacgugcacccggugaccaucggggagugccccaaguacguccgcuccgccaagcugcggauggugaccggccuccgcaacauccccagcauccagucccgggggcuguucggcgccaucgccggcuucaucgagggcggguggaccgggaugguggacggcugguacggguaccaccaccagaacgagcagggcucgggcuacgccgcggaccagaaguccacccagaacgccaucaacgggaucaccaacaaggucaacagcgugaucgagaagaugaacacgcaguucaccgccgugggcaaggaguucaacaagcuggagcgccggauggagaaccucaacaagaaggucgacgacggguuccuggacguguggaccuacaacgccgagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacaacgagugcauggaguccgugaagaacggcacguacgacuaccccaaguacagcgaggaguccaagcucaaccgggagaagaucgacggcgugaagcuggacucgauggggguguaccagauccuggcgaucuacuccaccgucgccagcagccucgugcugcuggugucccucggcgccaucagcuucuggaugugcuccaacgggagccugcagugccgcaucugcaucuga

SEQ ID NO: 496 - RNA, 1701 nt, Artificial Sequence
  derived and/or modified CDS sequence (AUadapt) from InfluenzaA__AAZ74397__HA
augaacaccaucaucgcccugucguacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccucguccaccgggcgcaucugcgacagcccccaccggauccuggacggcgagaacugcacccugaucgacgcccuccugggggacccccugugcgacggcuuccagaacaaggagugggaccucuucguggagcgcuccaaggccuacucgaacugcuaccccuacgacgugccggacuacgcgucccugcggagccuggucgccuccucgggcacgcucgaguucaacaacgaguccuucaacuggaccgggguggcccagaacggcaccagcuucgccugcaagcgccgguccaucaagucguucuucucccgccugaacuggcugcaccagcucaaguacaaguaccccgcgcugaacgugaccaugcccaacaacgacaaguucgacaagcuguacaucuggggcguccaccaccccgggacggacagcgaccagaccucccucuacgcccaggccucggggcgggugaccgugagcaccaagcgcucccagcagacggucaucccgaacaucggcucgcggcccugggugcgcggcguguccagccggaucuccaucuacuggaccaucgucaagcccggggacauccugcugaucaacucgaccggcaaccucaucgcgccccgcggguacuucaagauccgguccggcaagagcuccaucaugcgcucggacgccccgaucggcaagugcaacuccgagugcaucacccccaacgggagcauccccaacggcaagcccuuccagaacgugaaccggaucacguacggggccugcccgcgcuacgugaagcagaacacccugaagcuggccaccggcaugcggaacguccccgagaagcagacccgcgggaucuucggcgccaucgccggcuucaucgagaacgggugggagggcaugguggacgggugguacggcuuccggcaccagaacuccgaggggacgggccaggccgcggaccucaagucgacccaggccgccaucaaccagaucaacggcaagcugaaccgccugaucgagaagaccaacgagaaguuccaccagaucgagaaggaguucaccgagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagucgggcuacaaggacuggauccuguggaucuccuucgccaccagcugcuuccugcucugcgugguccugcugggguucaucaugugggccugccagaagggcaacauccggugcaacaucugcaucuga

SEQ ID NO: 497 - RNA, 1701 nt, Artificial Sequence
  derived and/or modified CDS sequence (AUadapt) from InfluenzaA__AAZ74408__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacaaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 498 - RNA, 1701 nt, Artificial Sequence; identical to SEQ ID NO: 431
  derived and/or modified CDS sequence (AUadapt) from InfluenzaA__AAZ74430__HA

SEQ ID NO: 499 - RNA, 1701 nt, Artificial Sequence; identical to SEQ ID NO: 488
  derived and/or modified CDS sequence (AUadapt) from InfluenzaA__AAZ74441__HA

SEQ ID NO: 500 - RNA, 1701 nt, Artificial Sequence
  derived and/or modified CDS sequence (AUadapt) from InfluenzaA__AAZ74452__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucaucgagcgcucgaaggccuacuccaacugcuaccccuacgacgugccggacuacgcgagccugcggucccucguggccucguccgggacgcuggaguucaacaacgagagcuucaacuggaccggcgucacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucucgacgaagcgcucgcagcagaccgugaucccgaacaucggcucccggccccgcgugcgggacauccccagccgcaucuccaucuacuggaccaucgucaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 501 - RNA, 1701 nt, Artificial Sequence
  derived and/or modified CDS sequence (AUadapt) from InfluenzaA__AAZ74463__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 502 - RNA, 1701 nt, Artificial Sequence
  derived and/or modified CDS sequence (AUadapt) from InfluenzaA__AAZ74474__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagaagcgcuccaacaacucguucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugucgacgaagcggucgcagcagaccgugaucccgaacaucggcucccgcccccggguccgcgacauccccagccggaucuccaucuacuggaccaucgugaagcccggggacauccugcucaucaacucgaccggcaaccugaucgccccgcgcggguacuucaagauccgguccggcaagagcuccaucaugcgcucggacgcccccaucggcaagugcaacuccgagugcaucacgcccaacgggucgauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 503 - RNA, 1701 nt, Artificial Sequence; identical to SEQ ID NO: 500
  derived and/or modified CDS sequence (AUadapt) from InfluenzaA__AAZ74485__HA

SEQ ID NO: 504 - RNA, 1701 nt, Artificial Sequence; identical to SEQ ID NO: 501
  derived and/or modified CDS sequence (AUadapt) from InfluenzaA__AAZ74496__HA

SEQ ID NO: 505 - RNA, 1701 nt, Artificial Sequence; identical to SEQ ID NO: 500
  derived and/or modified CDS sequence (AUadapt) from InfluenzaA__AAZ74507__HA

SEQ ID NO: 506 - RNA, 1701 nt, Artificial Sequence; identical to SEQ ID NO: 501
  derived and/or modified CDS sequence (AUadapt) from InfluenzaA__AAZ74518__HA

SEQ ID NO: 507 - RNA, 1701 nt, Artificial Sequence; identical to SEQ ID NO: 500
  derived and/or modified CDS sequence (AUadapt) from InfluenzaA__AAZ74529__HA

SEQ ID NO: 508 - RNA, 1701 nt, Artificial Sequence
  derived and/or modified CDS sequence (AUadapt) from InfluenzaA__AAZ74551__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgcucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcugaaguccggcuacaaggacuggauccucuggaucagcuucgccaucuccugcuuccugcugugcguggcccuccugggguucaucaugugggccugccagaagggcaacauccggugcaacaucugcaucuga

SEQ ID NO: 509 - RNA, 1701 nt, Artificial Sequence; identical to SEQ ID NO: 431
  derived and/or modified CDS sequence (AUadapt) from InfluenzaA__AAZ74562__HA

SEQ ID NO: 510 - RNA, 1701 nt, Artificial Sequence
  derived and/or modified CDS sequence (AUadapt) from InfluenzaA__AAZ74573__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucaucgagcgcucgaaggccuacuccaacugcuaccccuacgacgugccggacuacgcgagccugcggucccucguggccucguccgggacgcuggaguucaacaacgagagcuucaacuggaccggcgucacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccggcaacgaccagaucagccuguacgcgcaggccuccggccggaucaccgucucgacgaagcgcucgcagcagaccgugaucccgaacaucgggucccggccccgcgugcgggacauccccagccgcaucuccaucuacuggaccaucgucaagcccggcgacauccugcucaucaacucgaccgggaaccugaucgccccgcggggcuacuucaagauccgcuccggcaagagcuccaucaugcggucggacgcccccaucgggaagugcaacuccgagugcaucacgcccaacggcucgauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggcuucaucgagaacgggugggagggcaugguggacgggugguacggcuuccgccaccagaacuccgaggggaucggccaggccgccgaccugaaguccacccaggcggccaucaaccagaucaacggcaagcugaaccggcucaucgggaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcaccuacgaccacgacguguaccgggacgaggcccucaacaaccgcuuccagaucaagggcgucgagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 511 - RNA, 1701 nt, Artificial Sequence
  derived and/or modified CDS sequence (AUadapt) from InfluenzaA__AAZ74584__HA
augaagaccaucaucgcccugucguacauccucugccugguguucgcccagaagcugcccggcaacgacaacuccaccgcgacgcucugccuggggcaccacgccgucccgaacggcacccuggugaagaccaucgccaacgaccagaucgaggugaccaacgccacggagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggucgaaggcguacuccaacugcuaccccuacgacgugccggacuacgccagccuccgcucccuggucgccucguccggcacccuggaguucaacaacgagagcuucaacuggacggggguggcccagaacggcaccuccucggcgugcaagcggcgcuccaacaagucguucuucucccggcucaacuggcugcaccagcugaaguacaaguaccccgcccagaacgugaccaugcccaacaacgagaaguucgacaagcucuacaucuggggcguccaccaccccagcaccgacuccgaccagaucucgcuguacgcccaggccagcgggcgcgugacgguguccaccaagcggucgcagcagaccgucaucccgaacaucgggucccgccccugggugcggggcgugucgucccgcaucagcaucuacuggaccaucgucaagcccggcgacauccugcucaucaacuccacggggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucaccuacggggccugcccgcgguacgugaagcagaacacccugaagcucgccacgggcaugcgcaacguccccgagaagcagacccgggggaucuucggcgccaucgccggguucaucgagaacggcugggagggcaugguggacgggugguacggcuuccgccaccagaacucggaggggaccggccaggcggccgaccugaaguccacccaggccgccaucaaccagaucaacgggaagcugaaccggcucaucgagaagacgaacgagaaguuccaccagaucgagaaggaguucagcgagguggagggccgcauccaggaccuggagaaguacgucgaggacaccaagaucgaccugugguccuacaacgccgagcuccugguggcgcuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcguggcgcugcucggcuucaucaugugggccugccagaagggcaacauccggugcaacaucugcaucuga

SEQ ID NO: 512 - RNA, 1701 nt, Artificial Sequence; identical to SEQ ID NO: 488
  derived and/or modified CDS sequence (AUadapt) from InfluenzaA__AAZ74595__HA

SEQ ID NO: 513 - RNA, 1701 nt, Artificial Sequence
  derived and/or modified CDS sequence (AUadapt) from InfluenzaA__AAZ74617__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcuccaagaucagcaucuacuggaccaucgugaagcccggcgacauccuccugaucaacuccaccggcaaccugaucgcgccccggggguacuucaagauccggucgggcaaguccagcaucaugcgcuccaacgccccgaucgggaagugcaacucggagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucucggaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 514 - RNA, 1701 nt, Artificial Sequence; identical to SEQ ID NO: 292
  derived and/or modified CDS sequence (AUadapt) from InfluenzaA__AAZ79505__HA

SEQ ID NO: 515 - RNA, 1701 nt, Artificial Sequence
  derived and/or modified CDS sequence (AUadapt) from InfluenzaA__AAZ79516__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucucggagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugccugaagaucuaccacaagugcgacaacgccugcaucggcuccauccgcaacgggaccuacgaccacgacguguaccgggacgaggcccugaacaaccgcuuccagaucaagggcgucgagcucaagucgggguacaaggacuggauccuguggaucagcuucgccaucuccugcuuccugcucugcgugguccugcugggcuucaucaugugggccugccagaagggcaacauccggugcaacaucugcaucuga

SEQ ID NO: 516 - RNA, 1701 nt, Artificial Sequence
  derived and/or modified CDS sequence (AUadapt) from InfluenzaA__AAZ79527__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagcggcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagcgcuacguggaggacacgaagaucgaccuguggucguacaacgccgagcuccuggucgcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 517 - RNA, 1698 nt, Artificial Sequence
  derived and/or modified CDS sequence (AUadapt) from InfluenzaA__AAZ79549__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucgggaaccagcggacccuguaccacacggagaacgccuacgucucgguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 518 - RNA, 1701 nt, Artificial Sequence
  derived and/or modified CDS sequence (AUadapt) from InfluenzaA__AAZ79560__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcucaagucccuggucgccagcuccggcacgcuggaguucaacaacgagucguucaacuggaccgggguggcccagaacggcaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgggugaccguguccaccaagcgcucgcagcagaccgucaucccgaacaucgggucccggcccugggugcgcggcgugagcucccggaucucgaucuacuggacgaucgucaagcccggcgacauccuccugaucaacuccaccgggaaccugaucgcgccccgcggcuacuucaagauccggagcgggaaguccucgaucaugcgcuccaacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacucggaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 519 - RNA, 1701 nt, Artificial Sequence
  derived and/or modified CDS sequence (AUadapt) from InfluenzaA__AAZ79571__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccggugcgacggcuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccgggguggcccagaacggcaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgggugaccguguccaccaagcgcucgcagcagaccgucaucccgaacaucgggucccggcccugggugcgcggcgugagcucccggaucucgaucuacuggacgaucgucaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacucggaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 520 - RNA, 1701 nt, Artificial Sequence
  derived and/or modified CDS sequence (AUadapt) from InfluenzaA__AAZ79582__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucggguccggccccugggugcgcggcgugagcucccggaucucgaucuacuggacgaucgucaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacucggagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 521 - RNA, 1698 nt, Artificial Sequence
  derived and/or modified CDS sequence (AUadapt) from InfluenzaA__AAZ79604__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaaccgcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 522 - RNA, 1701 nt, Artificial Sequence
  derived and/or modified CDS sequence (AUadapt) from InfluenzaA__AAZ79615__HA
augaagaccaucaucgcccugucguacauccucugccugguguucgcccagaagauccccggcaacgacaacuccaccgcgacgcugugcgucgggcaccacgccgugccgaacggcaccaucgugaagaccaucaccaacgaccagaucgaggucacgaacgccaccgagcucgugcagucguccagcaccgggggcaucugcgacucgccccaccagauccuggacggggagaacugcacccugaucgacgcccuccugggcgacccccagugcgacggcuuccagaacaagaagugggaccuguucguggagcgcagcaaggccuacuccaacugcuaccccuacgacgucccggacuacgcgucgcuccggucccugguggccagcuccgggacgcuggaguucaacaacgagucguucaacuggaccggcgugacccagaacgggaccuccucggccugcaagcgccgguccaacaacagcuucuucucccgccucaacuggcugacgcaccugaaguucaaguaccccgcccucaacgucaccaugcccaacaacgagaaguucgacaagcuguacaucuggggcgugcaccaccccgggaccgacaacgaccagaucucgcuguacgcgcaggccuccggccggaucaccgugagcacgaagcgcucgcagcagaccgucaucccgaacaucggcucccggccccgcgugcgggacauccccagccgcaucuccaucuacuggaccaucgugaagcccggggacauccuccugaucaacucgaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgucaaccgcaucaccuacggcgccugcccccgguacgugaagcagaacacccucaagcuggcgaccgggaugcgcaacgugcccgagaagcagacgcggggcaucuucggggccaucgccggcuucaucgagaacggcugggaggggauggucgacggcugguacggguuccgccaccagaacuccgagggcaucgggcaggccgccgaccugaaguccacccaggcggccaucaaccagaucaacggcaagcucaaccggcugaucggcaagaccaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacguguaccgggacgaggcccugaacaaccgcuuccagaucaagggcguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 523 - RNA, 1701 nt, Artificial Sequence
  derived and/or modified CDS sequence (AUadapt) from InfluenzaA__AAZ79627__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagagcuucaacuggaccggcgugacccagaacgggaccuccucggccugcaagcgccgguccaacagcuccuucuucucgcgccugaacuggcucacgcaccugaaguucaaguaccccgcccugaaggugaccaugcccaacaacgagaaguucgacaagcucuacaucuggggcguccaccaccccgggaccgacaacgaccagaucucccuguacgcgcaggccucgggccggaucaccgugagcacgaagcgcucccagcagaccgugaucccgaacaucggcucgcggccccgcguccgggacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 524 - RNA, 1701 nt, Artificial Sequence; identical to SEQ ID NO: 501
  derived and/or modified CDS sequence (AUadapt) from InfluenzaA__AAZ79941__HA

SEQ ID NO: 525 - RNA, 1701 nt, Artificial Sequence; identical to SEQ ID NO: 500
  derived and/or modified CDS sequence (AUadapt) from InfluenzaA__AAZ79944__HA

SEQ ID NO: 526 - RNA, 1701 nt, Artificial Sequence
  derived and/or modified CDS sequence (AUadapt) from InfluenzaA__AAZ79963__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccguccaucggcagccggccccgcauccgggacguccccucccgcaucucgaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 527 - RNA, 1701 nt, Artificial Sequence
  derived and/or modified CDS sequence (AUadapt) from InfluenzaA__AAZ79974__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccaacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 528 - RNA, 1701 nt, Artificial Sequence; identical to SEQ ID NO: 500
  derived and/or modified CDS sequence (AUadapt) from InfluenzaA__AAZ79996__HA

SEQ ID NO: 529 - RNA, 1701 nt, Artificial Sequence
  derived and/or modified CDS sequence (AUadapt) from InfluenzaA__AAZ80007__HA
augaagaccaucaucgcccugucgcacaucuucugccucgugcugggccaguaccugcccgggaacgacaacuccaccgccacgcucugccugggccaccacgcggucccgaacgggacccuggugaagaccaucaccaacgaccagaucgaggugacgaacgccaccgagcucguccagucguccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucucgaacugcuaccccuacgacgugccggacuacgccucccuccgcagccuggucgcguccucggggacccuggaguucaucaccgagggcuucaccuggacgggggugacccagaacggcggguccaacgccugcaagcggggccccggcagcggguucuucucccgccucaacuggcugaccaagucggaguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgccccgcggggguacuucaagaugcgcaccggcaaguccagcaucaugcgguccgacgcgcccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgccggguucaucgagaacggcugggaggggaugaucgacggcugguacggcuuccgccaccagaacagcgaggggaccggccaggcggccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgccgagcuccuggucgcgcuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggugcugcucggguucaucaugugggcgugccagcgcggcaacauccggugcaacaucugcaucuga

SEQ ID NO: 530 - RNA, 1701 nt, Artificial Sequence; identical to SEQ ID NO: 501
  derived and/or modified CDS sequence (AUadapt) from InfluenzaA__AAZ80017__HA

SEQ ID NO: 531 - RNA, 1701 nt, Artificial Sequence
  derived and/or modified CDS sequence (AUadapt) from InfluenzaA__AAZ80030__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaccucgcuguacgcgcaggccuccggccggaucacggugagcaccaagcgcucgcagcagaccgugaucccgaacaucggcucccggccccgcguccgggacauccccucgcgcaucuccaucuacuggaccaucgugaagcccggggacauccugcucaucaacagcacgggcaaccugaucgccccgcggggguacuucaagauccgcuccggcaagucguccaucaugcggucggacgcccccaucggcaagugcaacuccgagugcaucacccccaacgggagcauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 532 - RNA, 1701 nt, Artificial Sequence
  derived and/or modified CDS sequence (AUadapt) from InfluenzaA__AAZ83242__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccggggagaucugcgacagcccccaccagauccucgacggcgagaacugcacccugaucgacgcccugcucggggacccccagugcgacggcuuccagaacaagaagugggaccuguucguggagcgcaacaaggccuacucgaacugcuaccccuacgacgugccggacuacgcgucccugcggucgcucgucgccuccucgggcacgcuggaguucaacaacgaguccuucaacuggaccggggugacccagaacggcaccagcuccgccugcaagcgccggucgaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucaaccuguacgcgcaggccucggggcggaucaccguguccacgaagcgcagccagcagaccgugaucccgaacaucggcuaccggccccgcguccgggacgugcccucgcgcaucuccaucuacuggaccaucgugaagcccggcgacauccugcucaucaacucgaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagucgacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcacguacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 533 - RNA, 1701 nt, Artificial Sequence
  derived and/or modified CDS sequence (AUadapt) from InfluenzaA__AAZ83266__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaacgagcucguccagucguccagcaccgggcgcaucugcgacucgccccaccagauccuggacggcgagaacugcacccugaucgacgcccuccugggggacccccggugcgacggcuuccagaacaaggagugggaccuguucguggagcgcagcaaggccuacuccaacugcuaccccuacgacgugccggacuacgcgucgcuccggucccuggucgccagcuccggcacccuggaguucaacaacgagucguucaacuggacggggguggcccagaacggcaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcaccgacuccgaccagaucucgcuguacgcccaggccagcgggcgggugacgguguccaccaagcgcucgcagcagaccgucaucccgaacaucgggucccggcccugggugcgcggcgugagcucccggaucucgaucuacuggaccaucgucaagcccggcgacauccuccugaucaacuccacggggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacccucaagcuggccacgggcaugcggaacguccccgagaagcagacccgcgggaucuucggcgccaucgccggguucaucgagaacggcugggagggcaugguggacgggugguacggcuuccggcaccagaacucggaggggaccggccaggccgcggaccugaaguccacccaggccgccaucaaccagaucaacgggaagcucaaccgccugaucgagaagacgaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugaccgacucggagaugaacaagcuguucgagcgcacgaagaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 534 - RNA, 1701 nt, Artificial Sequence; identical to SEQ ID NO: 431
  derived and/or modified CDS sequence (AUadapt) from InfluenzaA__AAZ83277__HA

SEQ ID NO: 535 - RNA, 1701 nt, Artificial Sequence; identical to SEQ ID NO: 317
  derived and/or modified CDS sequence (AUadapt) from InfluenzaA__AAZ83288__HA

SEQ ID NO: 536 - RNA, 1701 nt, Artificial Sequence
  derived and/or modified CDS sequence (AUadapt) from InfluenzaA__AAZ83312__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaucaagucguucuucucccggcucaacuggcugcaccagcugaaguacaaguaccccgcgcucaacgugaccaugcccaacaacgacaaguucgacaagcuguacaucuggggcguccaccaccccagcacggacuccgaccagaccucgcuguacgcccaggccagcgggcgcgugaccguguccaccaagcggucgcagcagacggucaucccgaacaucgggucccgccccugggugcggggcgugagcucccgcaucucgaucuacuggaccaucgucaagcccggcgacauccuccugaucaacuccaccgggaaccugaucgcgccccggggcuacuucaagauccgcagcgggaaguccucgaucauccgguccgacgccccgaucggcaagugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacucggaggggacgggccaggccgcggaccugaaguccacccaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacacgaucgaccugaccgacucggagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 537 - RNA, 1701 nt, Artificial Sequence
  derived and/or modified CDS sequence (AUadapt) from InfluenzaA__AAZ83323__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcgagaacugcacccugaucgacgcccuccugggggacccccacugcgacggcuuccagaacaaggagugggaccuguucguggagcgcucgaaggccuacuccaacugcuaccccuacgacgugcaggacuacgcgagccuccggucccuggucgccucguccggcacgcuggaguucaacaacgagagcuucaacuggaccgggguggcccagaacggcaccuccuacgccugcaagcgccggucgaucaaguccuucuucagccgccucaacuggcugcaccagcugaaguacaaguacccggcgcucaacgugaccaugcccaacaacgacaaguucgacaagcuguacaucuggggcguccaccaccccuccacggacucggaccagaccucccuguacgcccaggccagcgggcgggugaccgugucgaccaagcgcucccagcagacggucaucagcaacaucgggucccggcccugggugcgcggcgugucgucccggaucagcaucuacuggaccaucgucaagccgggcgacauccuccugaucaccuccaccgggaaccugaucgcgccccgcggcuacuucaagauccggucggggaaguccagcaucaugcgcuccgacgcccccaucggcaagugcaacucggagugcaucacgcccaacggcuccaucccgaacgacaagcccuuccagaacgugaaccggaucaccuacggggccugcccccgcuacgugaagcagaacacccucaagcuggccaccggcaugcggaacguccccgagaagcagacgcgcgggaucuucggcgccaucgccggguucaucgagaacggcugggagggcaugguggacgggugguacggcuuccggcaccagaacagcgaggggaccggccaggccgcggaccugaaguccacccaggccgccaucaaccagaucaacgggaagcucaaccgccugaucgagaagaccaacgagaaguuccaccagaucgagaaggaguucucggagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 538 - RNA, 1701 nt, Artificial Sequence; identical to SEQ ID NO: 527
  derived and/or modified CDS sequence (AUadapt) from InfluenzaA__AAZ83371__HA

SEQ ID NO: 539 - RNA, 1701 nt, Artificial Sequence; identical to SEQ ID NO: 500
  derived and/or modified CDS sequence (AUadapt) from InfluenzaA__AAZ83688__HA

SEQ ID NO: 540 - RNA, 1698 nt, Artificial Sequence
  derived and/or modified CDS sequence (AUadapt) from InfluenzaA__ABA06510__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucgccaaggagagcugguccuacaucgucgagacccccaaccccgagaacggcgccugcuaccccggcuacuucgccgacuacgaggagcugcgcgagcagcucagcuccgugucguccuucgagcgguucgagaucuucccgaaggagagcuccuggcccaaccacacggugaccggggucagcgccuccugcagccacaacggcaaguccucguucuaccgcaaccugcuguggcucaccgggaagaacggccuguaccccaaccuguccaagagcuacgccaacaacaaggagaaggaggugcucauccuguggggcgugcaccacccgcccaacaucggggaccagcggacccuguaccacacggagaacgccuacgucuccguggugagcagccacuacucccgccgguucacccccgagaucaccaagcgccccaagguccgggaccaggagggccgcaucaacuacuacuggacccuccuggagcccggggacacgaucaucuucgaggcgaacggcaaccugaucgccccgugguacgccuucgcccucucgcggggguucggcuccggcaucaucaccagcaacgcccccauggacgagugcgacgcgaagugccagacgccccagggggccaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgucaagaaccuguacgagaaggucaagagccagcugaagaacaacgcgaaggagaucgggaacggcugcuucgaguucuaccacaagugcaacaacgagugcauggaguccgugaagaacgggacguacgacuaccccaaguacagcgaggaguccaagcucaaccgggagaagaucgacggcgugaagcuggacucgaugggcguguaccagauccuggccaucuacuccaccguggccagcagccucguccugcuggugucccucggggccaucagcuucuggaugugcuccaacggcagccugcagugccgcaucugcaucuga

SEQ ID NO: 541 - RNA, 1698 nt, Artificial Sequence
  derived and/or modified CDS sequence (AUadapt) from InfluenzaA__ABA08464__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 542 - RNA, 1698 nt, Artificial Sequence; identical to SEQ ID NO: 541
  derived and/or modified CDS sequence (AUadapt) from InfluenzaA__ABA08486__HA

SEQ ID NO: 543 - RNA, 1698 nt, Artificial Sequence
  derived and/or modified CDS sequence (AUadapt) from InfluenzaA__ABA08508__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagucguccuucuaccgcaaccugcuguggcucaccgggaagaacggccuguaccccaaccugagcaaguccuacgccaacaacaagaagaaggaggugcucauccuguggggcgugcaccacccgcccaacaucgggguccagcggacccuguacuacacggagaacgccuacgugagcguggucagcucccacuacagccgccgguucacccccgagaucaccaagcgccccaaggugcgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggucaccaucggcgagugccccaaguacgugcgcagcgccaagcugcggauggugaccgggcuccgcaacauccccuccauccagucgcggggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcgccggauggagaaccucaacaagaagguggacgacggcuuccuggacaucuggaccuacaacgccgagcugcucguccugcuggagaacgagcgcacccucgacuuccacgacagcaacgugaagaaccuguacgagaaggugaagucccagcugaagaacaacgccaaggagaucgggaacggcugcuucgaguucuaccacaagugcaacaacgagugcauggagagcgucaagaacgggacguacgacuaccccaaguacuccgaggagagcaagcucaaccgggagaagaucgacggcgugaagcuggacuccaugggcguguaccagauccuggcgaucuacagcaccgucgccagcucccucgugcugcuggugagccucggggccaucuccuucuggaugugcagcaacggcucccugcagugccgcaucugcaucuga

SEQ ID NO: 544 - RNA, 1698 nt, Artificial Sequence
  derived and/or modified CDS sequence (AUadapt) from InfluenzaA__ABA12707__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 545 - RNA, 1698 nt, Artificial Sequence
  derived and/or modified CDS sequence (AUadapt) from InfluenzaA__ABA12715__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagucguccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcaccaagcugcggauggucaccggccuccgcaacauccccuccauccagucgcgggggcuguucggcgccaucgccggcuucaucgagggcggguggaccgggaugguggacggcugguacggguaccaccaccagaacgagcagggcuccggcuacgccgcggaccagaaguccacccagaacgccaucaacgggaucaccaacaaggugaacagcgucaucgagaagaugaacacgcaguucaccgccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucggcaacgggugcuucgaguucuaccacaagugcgacaacgagugcauggagagcgugaagaacggcacguacgacuaccccaaguacuccgaggagagcaagcucaaccgggagaagaucgacggcgugaagcuggaguccaugggggucuaccagauccuggcgaucuacagcaccguggccagcucccucguguuccuggucagccugggcgccaucuccuucuggaugugcagcaacgggucccuccagugccgcaucugcaucuga

SEQ ID NO: 546 - RNA, 1698 nt, Artificial Sequence
  derived and/or modified CDS sequence (AUadapt) from InfluenzaA__ABA12729__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacaucagcguggucagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggugaccgggcuccggaacauccccuccauccagucgcgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggaccuacgacuacccccgcuacuccgaggagucgaagcucaaccgggagaagaucgacggcgugaagcuggaguccaugggcguguaccagauccuggccaucuacagcacggucgccagcucccucgugcugcuggugagccucggggccaucuccuucuggaugugcagcaacggcucccugcagugccgcaucugcaucuga

SEQ ID NO: 547 - RNA, 1701 nt, Artificial Sequence; identical to SEQ ID NO: 531
  derived and/or modified CDS sequence (AUadapt) from InfluenzaA__ABA12740__HA

SEQ ID NO: 548 - RNA, 1701 nt, Artificial Sequence; identical to SEQ ID NO: 500
  derived and/or modified CDS sequence (AUadapt) from InfluenzaA__ABA12751__HA

SEQ ID NO: 549 - RNA, 1701 nt, Artificial Sequence
  derived and/or modified CDS sequence (AUadapt) from InfluenzaA__ABA12762__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccucguccgggacgcucgaguucaacaacgagagcuucaacuggaccggcgugacccagaacgggaccuccucggccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucucgcucuacgcgcaggccuccggccggaucaccgugagcacgaagcgcucgcagcagaccgugaucccgaacaucggcucccggccccgcguccgggacauccccagccgcaucuccaucuacuggaccaucgugaagcccggggacauccugcugaucaacucgaccggcaaccucaucgccccgcggggguacuucaagauccgcuccggcaagagcuccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagucgacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcgugguccugcugggguucaucaugugggccugccagaagggcaacauccggugcaacaucugcaucuga

SEQ ID NO: 550 - RNA, 1701 nt, Artificial Sequence
  derived and/or modified CDS sequence (AUadapt) from InfluenzaA__ABA12773__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaacgagggcuucaccuggaccggggugacgcagaacggcggguccaacgccugcaagcggggccccgacagcggcuucuucucccgccugaacuggcucuacaagucgggguccaccuaccccgugcugaacgucaccaugcccaacaacgacaacuucgacaagcuguacaucuggggcgugcaccacccgagcaccgaccaggagcagacgucccucuacgugcaggccucggggcgggucaccguguccaccaagcgcagccagcagaccaucauccccaacaucggcucgcggcccugggugcgcggccuguccagccggaucuccaucuacuggacgaucgucaagcccggggacauccuggugaucaacagcaacggcaaccucaucgccccgcgcggguacuucaagaugcggaccggcaaguccucgaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcuggccaccgggaugcggaacgugcccgagaagcagacccgcggccucuucggggccaucgccggcuucaucgagaacgggugggagggcaugaucgacggcugguacggguuccggcaccagaacucggagggcacggggcaggcggccgaccugaaguccacccaggccgccaucgaccagaucaacggcaagcugaaccgcgugaucgagaagaccaacgagaaguuccaccagaucgagaaggaguucagcgaggucgaggggcggauccaggaccucgagaaguacguggaggacaccaagaucgaccugugguccuacaacgccgagcugcucguggcgcuggagaaccagcacacgaucgaccugaccgacucggagaugaacaagcuguucgagaagacccgccggcagcuccgcgagaacgccgaggacaugggcaacggcugcuucaagaucuaccacaagugcgacaacgccugcaucggguccauccggaacggcaccuacgaccacgacgucuaccgcgacgaggcccugaacaaccgcuuccagaucaaggggguggagcucaagagcggcuacaaggacuggauccuguggaucuccuucgccaucagcugcuuccugcucugcgucgugcugcugggcuucaucaugugggcgugccagaaggggaacauccggugcaacaucugcaucuga

SEQ ID NO: 551 - RNA, 1701 nt, Artificial Sequence
  derived and/or modified CDS sequence (AUadapt) from InfluenzaA__ABA12780__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccaacaacgaccagaucagccuguacgcgcaggccuccggccggaucaccgugucgacgaagcgcucgcagcagaccgugaucccgaacaucgagucccggccccgcguccgggacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 552 - RNA, 1701 nt, Artificial Sequence
  derived and/or modified CDS sequence (AUadapt) from InfluenzaA__ABA16214__HA
augaagaccaucaucgcccugucguacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucucgaacugcuaccccuacgacgugccggacuacgcgucccugcggagccucgucgccuccucgggcacgcuggaguucaucaacgagggguucaacuggaccggcgugacccaguccgggggcagcuacgccugcaagcgcggguccgucaagucguucuucucccggcugaacuggcucuacgagagcgaguccaaguaccccgcccugaacgugaccaugcccaacaacggcaaguucgacaagcuguacaucuggggcgugcaccaccccucgacggacaaggagcagaccaaccucuacgugcgcgcgagcgggcgggucaccguguccaccaagcgcucgcagcagacggugaucccgaacaucggcccccggcccuggguccgcgggcuguccagccggaucuccaucuacuggaccaucgugaagcccggcgacauccugcucaucaacucgaccggcaaccugaucgccccgcgcggguacuucaagauccggaccggcaaguccagcaucaugcgcuccgacgcccccaucgggacgugcucguccggcugcaucacccccaacgggagcauccccaacgacaagccguuccagaacgugaacaagaucaccuacggcgccugcccccgguacgucaagcagaacacccugaagcucgccacgggcaugcgcaacgugcccgagaagcagacccgggggaucuucggcgcgaucgccggguucaucgagaacggcugggaggggaugguggacggcugguacggcuuccgccaccagaacuccgaggggaccggccaggccgccgaccucaagucgacccaggccgcgaucgaccagaucaacgggaagcugaaccggcucaucgagaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgacaugaccgacuccgagaugaacaagcuguucgagaagacgcggaagcagcugcgcgagaacgccgaggacauggggaacggcugcuucaagaucuaccacaagugcgacaacgccugcaucggcucgauccgcaacgggaccuacgaccacgacgucuaccgggacgaggcgcugaacaaccgcuuccagaucaagggcguggagcucaaguccggguacaaggacuggauccuguggaucagcuucgccaucagcugcuuccugcucugcgucgugcugcugggcuucaucaugugggccugccagaagggcaacauccggugcaacaucugcaucuga

SEQ ID NO: 553 - RNA, 1701 nt, Artificial Sequence; identical to SEQ ID NO: 501
  derived and/or modified CDS sequence (AUadapt) from InfluenzaA__ABA18026__HA

SEQ ID NO: 554 - RNA, 1698 nt, Artificial Sequence
  derived and/or modified CDS sequence (AUadapt) from InfluenzaA__ABA18037__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugaaggagcagcucuccagcguguccagcuucgagcgcuucgagaucuucccgaagggguccucguggcccaaccacaccgugaccggcgucuccgccagcugcucccacaacggcaagagcuccuucuaccggaaccugcuguggcucaccgggaagaacgggcuguaccccaaccugagcauguccuacgugaacaacaaggagaaggaggugcucguccuguggggcgugcaccacccgcccaacaucggcgaccagcgcgcccuguaccacacggagaacgccuacgugagcgucgugagcucccacuacucgcggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacucgaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 555 - RNA, 1701 nt, Artificial Sequence; identical to SEQ ID NO: 500
  derived and/or modified CDS sequence (AUadapt) from InfluenzaA__ABA18048__HA

SEQ ID NO: 556 - RNA, 1701 nt, Artificial Sequence
  derived and/or modified CDS sequence (AUadapt) from InfluenzaA__ABA18123__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgggccccugggugcgcggggucuccagccggaucuccaucuacuggacgaucgugaagcccggcgacauccuccugaucaacucgaccgggaaccugaucgcgccccgcggcuacuucaagauccgguccggcaagagcuccaucaugcgcucggacgccccgaucgggaagugcaacuccgagugcaucacccccaacggcagcauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggcggccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgcgugcaucggcagcauccgcaacgggaccuacgaccacgacguguaccgcgacgaggcccugaacaaccgguuccagaucaagggcgucgagcugaaguccggcuacaaggacuggauccucuggaucucguucgccaucagcugcuuccugcugugcaucgugcuccugggguucaucaugugggccugccagaagggcaacauccgcugcaacaucugcaucuga

SEQ ID NO: 557 - RNA, 1701 nt, Artificial Sequence; identical to SEQ ID NO: 500
  derived and/or modified CDS sequence (AUadapt) from InfluenzaA__ABA18134__HA

SEQ ID NO: 558 - RNA, 1698 nt, Artificial Sequence; identical to SEQ ID NO: 544
  derived and/or modified CDS sequence (AUadapt) from InfluenzaA__ABA18145__HA

SEQ ID NO: 559 - RNA, 1701 nt, Artificial Sequence; identical to SEQ ID NO: 501
  derived and/or modified CDS sequence (AUadapt) from InfluenzaA__ABA18156__HA

SEQ ID NO: 560 - RNA, 1701 nt, Artificial Sequence
  derived and/or modified CDS sequence (AUadapt) from InfluenzaA__ABA26700__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcaacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccccgggccggaucaccguguccacgaagcgcagccagcagaccgugauccccaacaucggcucgcggccccgcguccgggacauccccucccgcaucucgaucuacuggaccaucgugaagccgggggacauccugcucaucaacuccaccggcaaccugaucgcgccccggggguacuucaagauccgcagcggcaaguccucgaucaugcgguccgacgcccccaucggcaagugcaacucggagugcaucacgcccaacggguccaucccgaacgacaagcccuuccagaacgugaaccgcaucaccuacggcgccugcccccgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 561 - RNA, 1701 nt, Artificial Sequence
  derived and/or modified CDS sequence (AUadapt) from InfluenzaA__ABA26711__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaaguccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 562 - RNA, 1701 nt, Artificial Sequence
  derived and/or modified CDS sequence (AUadapt) from InfluenzaA__ABA26722__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucgucccccaccgggggcaucugcgacucgccccaccagauccucgacggggagaacugcacccugaucgacgcccugcucggcgacccccagugcgacggcuuccagaacaagaagugggaccuguucguggagcgcuccaaggcccacucgaacugcuacccguacgacgugcccgacuacgcgucccugcggagccucgucgccuccucggggacgcuggaguucaacaacgaguccuucaacuggaccggcgugacccagaacgggaccucguccgccugcaagcgccggucgaacaaguccuucuucagccgccugaacuggcucacgcaccugaaguucaaguaccccgcccugaacgugaccaugcccaacaacgagaaguucgacaagcucuacaucuggggcguccaccacccggggaccgacaacgaccagaucucccuguacgcgcaggccucgggccggaucaccguguccacgaagcgcucgcagcagaccgugauccccaacaucggcucgcggccccgcguccgggacgugcccucccgcaucagcaucuacuggaccaucgugaagccgggggacauccugcucaucaacuccaccggcaaccugaucgcgccccggggguacuucaagauccgcucgggcaaguccucgaucaugcgguccgacgcccccaucggcaagugcaacucggggugcaucacgcccaacggcuccaucccgaacgacaagcccuuccagaacgucaaccgcaucaccuacggggccugcccccgguacgugaagcagaacacccugaagcucgccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcugaaccggcucaucgggaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaagggcguggagcucaagucgggguacaaggacuggauccuguggaucuccuucgccaucagcugcuuccugcugugcgucgcccugcucggcuucaucaugugggccugccagaaggggaacauccggugcaacaucugcaucuga

SEQ ID NO: 563 - RNA, 1701 nt, Artificial Sequence; identical to SEQ ID NO: 488
  derived and/or modified CDS sequence (AUadapt) from InfluenzaA__ABA26733__HA

SEQ ID NO: 564 - RNA, 1701 nt, Artificial Sequence; identical to SEQ ID NO: 488
  derived and/or modified CDS sequence (AUadapt) from InfluenzaA__ABA26755__HA

SEQ ID NO: 565 - RNA, 1701 nt, Artificial Sequence; identical to SEQ ID NO: 527
  derived and/or modified CDS sequence (AUadapt) from InfluenzaA__ABA26766__HA

SEQ ID NO: 566 - RNA, 1701 nt, Artificial Sequence; identical to SEQ ID NO: 527
  derived and/or modified CDS sequence (AUadapt) from InfluenzaA__ABA26788__HA

SEQ ID NO: 567 - RNA, 1701 nt, Artificial Sequence; identical to SEQ ID NO: 527
  derived and/or modified CDS sequence (AUadapt) from InfluenzaA__ABA26799__HA

SEQ ID NO: 568 - RNA, 1698 nt, Artificial Sequence
  derived and/or modified CDS sequence (AUadapt) from InfluenzaA__ABA42247__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuacaagaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacucgcggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 569 - RNA, 1698 nt, Artificial Sequence; identical to SEQ ID NO: 541
  derived and/or modified CDS sequence (AUadapt) from InfluenzaA__ABA42258__HA

SEQ ID NO: 570 - RNA, 1701 nt, Artificial Sequence; identical to SEQ ID NO: 500
  derived and/or modified CDS sequence (AUadapt) from InfluenzaA__ABA42269__HA

SEQ ID NO: 571 - RNA, 1698 nt, Artificial Sequence
  derived and/or modified CDS sequence (AUadapt) from InfluenzaA__ABA42280__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucucgguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 572 - RNA, 1701 nt, Artificial Sequence
  derived and/or modified CDS sequence (AUadapt) from InfluenzaA__ABA42291__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaaguccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagacggaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 573 - RNA, 1701 nt, Artificial Sequence; identical to SEQ ID NO: 296
  derived and/or modified CDS sequence (AUadapt) from InfluenzaA__ABA42302__HA

SEQ ID NO: 574 - RNA, 1701 nt, Artificial Sequence; identical to SEQ ID NO: 350
  derived and/or modified CDS sequence (AUadapt) from InfluenzaA__ABA42313__HA

SEQ ID NO: 575 - RNA, 1701 nt, Artificial Sequence; identical to SEQ ID NO: 296
  derived and/or modified CDS sequence (AUadapt) from InfluenzaA__ABA42346__HA

SEQ ID NO: 576 - RNA, 1701 nt, Artificial Sequence; identical to SEQ ID NO: 350
  derived and/or modified CDS sequence (AUadapt) from InfluenzaA__ABA42357__HA

SEQ ID NO: 577 - RNA, 1701 nt, Artificial Sequence
  derived and/or modified CDS sequence (AUadapt) from InfluenzaA__ABA42379__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagcaagaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgccugcaucgggagcauccgcaacggcaccuacgaccacgacguguaccgcgacgaggcgcugaacaaccgguuccagaucaagggggucgagcugaaguccggcuacaaggacuggauccucuggaucucguucgccaucagcugcuucgugcugugcaucguccugcucggcuucaucaugugggccugccagaaggggaacauccgcugcaacaucugcaucuga

SEQ ID NO: 578 - RNA, 1701 nt, Artificial Sequence; identical to SEQ ID NO: 325
  derived and/or modified CDS sequence (AUadapt) from InfluenzaA__ABA42390__HA

SEQ ID NO: 579 - RNA, 1701 nt, Artificial Sequence
  derived and/or modified CDS sequence (AUadapt) from InfluenzaA__ABA42401__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcagagcuccggccgcgugaccgucagcaccaagcggucccagcagaccgugaucccgaacaucgggucgggccccugggugcgcggcgucuccagccggaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccaagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccucaagucgacgcaggccgcgaucaaccagaucaacggcaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgccugcaucgggucgauccgcaacggcaccuacgaccacgacguguaccgcgacgaggcgcugaacaaccgguuccagaucaagggggucgagcucaagagcggcuacaaggacuggauccuguggaucuccuucgccaucagcugcuuccugcugugcaucgugcuccugggcuucaucaugugggccugccagaaggggaacauccgcugcaacaucugcaucuga

SEQ ID NO: 580 - RNA, 1701 nt, Artificial Sequence
  derived and/or modified CDS sequence (AUadapt) from InfluenzaA__ABA42412__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgaagaucuccaucuacuggacgaucgugaagcccggggacauccuccugaucaacagcaccggcaaccugaucgcgccccgcggguacuucaagauccgguccggcaagucguccaucaugcgcagcgacgccccgaucggcaagugcaacuccgagugcaucacccccucgggguccauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacagcgagggcaccgggcaggccgccgaccugaaguccacgcaggccgcgaucaaccagaucaacggcaagcucaaccgccugaucgagaagaccaacgagaaguuccaccagaucgagaaggaguucucggagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacauggggaacggcugcuucaagaucuaccacaagugcgacaacgccugcaucggguccauccgcaacggcaccuacgaccacgacguguaccgcgacgaggcgcugaacaaccgguuccagaucaagggggucgagcugaaguccggcuacaaggacuggauccucuggaucagcuucgccaucuccugcuuccugcugugcaucgugcuccugggcuucaucaugugggccugccagaaggggaacauccgcugcaacaucugcaucuga

SEQ ID NO: 581 - RNA, 1701 nt, Artificial Sequence; identical to SEQ ID NO: 292
  derived and/or modified CDS sequence (AUadapt) from InfluenzaA__ABA42443__HA

SEQ ID NO: 582 - RNA, 1701 nt, Artificial Sequence; identical to SEQ ID NO: 296
  derived and/or modified CDS sequence (AUadapt) from InfluenzaA__ABA42454__HA

SEQ ID NO: 583 - RNA, 1701 nt, Artificial Sequence
  derived and/or modified CDS sequence (AUadapt) from InfluenzaA__ABA42465__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccucccgcaucugcgacucgccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcucgcugguggcguccagcggcacgcuggaguucaacaacgaguccuucaacuggaccggcguggcccagaacgggaccucguccgccugcaagcggcgcagcgacaaguccuucuucucgcggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccucgggccgcgugaccgucuccaccaagcggagccagcagaccgugaucccgaacaucgggucccgccccuggggccggggcgugucgucccgcaucagcaucuacuggacgaucgucaagcccggggacauccuccugaucaacuccaccggcaaccugaucgcgccccggggguacuucaagauccgcucgggcaaguccagcaucaugcgguccgacgccccgaucggcaagugcaacucggagugcaucacccccaacggguccauccccaacgacaagcccuuccagaacgugaaccgcaucaccuacggcgccugcccgcgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucucggagguggagggccgcauccaggaccuggagaaguacguggaggacaccaagaucgaccucugguccuacaacgccgagcugcuggucgcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaaggggguggagcucaagucgggcuacaaggacuggauccuguggaucagcuucgccaucuccugcuuccugcugugcaucguccuccugggcuucaucaugugggccugccagaaggggaacauccggugcaacaucugcaucuga

SEQ ID NO: 584 - RNA, 1701 nt, Artificial Sequence
  derived and/or modified CDS sequence (AUadapt) from InfluenzaA__ABA42476__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccggaacgaggcgcugaacaaccgcuuccagaucaagggggucgagcugaaguccggcuacaaggacuggauccucuggaucucguucgccaucagcugcuuccugcugugcaucgugcuccugggcuucaucaugugggccugccagaaggggaacauccggugcaacaucugcaucuga

SEQ ID NO: 585 - RNA, 1701 nt, Artificial Sequence
  derived and/or modified CDS sequence (AUadapt) from InfluenzaA__ABA42498__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcagcgacaaguccuucuucucgcggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccucgggccgcgugaccgucuccaccaagcggagccagcagaccgugaucccgaacaucgggucccgccccugggugcggggcgucucguccaucaucagcaucuacuggacgaucgugaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggguucaucgagaacggcugggagggcaugauggacgggugguacggcuuccggcaccagaacucggaggggaccggccaggccgccgaccugaaguccacgcaggcggccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgccgaggacaugggcaacgggugcuucaagaucuaccacaagugcgacaacgcgugcaucggcuccauccgcaacgggaccuacgaccacgacguguaccgcgacgaggcccugaacaaccgguuccagaucaagggcgucgagcucaagagcggguacaaggacuggauccuguggaucagcuucgccaucuccugcuuccugcugugcaucgugcuccugggcuucaucaugugggccugccagaagggcaacauccgcugcaacaucugcaucuga

SEQ ID NO: 586 - RNA, 1701 nt, Artificial Sequence; identical to SEQ ID NO: 317
  derived and/or modified CDS sequence (AUadapt) from InfluenzaA__ABA42509__HA

SEQ ID NO: 587 - RNA, 1701 nt, Artificial Sequence
  derived and/or modified CDS sequence (AUadapt) from InfluenzaA__ABA42520__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgacuacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgucgcuccgcucccugguggccagcuccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggagccagcagacggugaucccgaacaucggcucccgccccugggugcgcggggucucguccaucaucagcaucuacuggaccaucgugaagcccggcgacauccuccugaucaacuccaccggcaaccugaucgcgccccggggguacuucaagauccggagcggcaaguccucgaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucucggaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 588 - RNA, 1701 nt, Artificial Sequence
  derived and/or modified CDS sequence (AUadapt) from InfluenzaA__ABA42531__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcgguccacggccuacuccaacugcuaccucuacgacguccccgacuacgcgagccugcgcucccugguggccucguccggcacccucgaguucaacaacgagagcuucaacuggaccggcguggcccagaacgggaccuccucggccugcaagcggcgcuccaucaagagcuucuucucccggcugaacuggcugcaccagcucaaguacaaguacccggcgcugaacgucacgaugcccaacaacgagaaguucgacaagcuguacaucuggggcgugcaccaccccagcaccgacuccgaccagaucucgcucuacgcccaggccagcgggcgcgugaccgucuccaccaagcggucgcagcagacggugauccccaacaucggcucccgcccgugggugcgcggggucagcucccggaucagcaucuacuggaccaucgugaagcccggcgacauccugcugaucaacuccaccggcaaccucaucgcgccccggggguacuucaagauccgcucgggcaaguccagcaucaugcgguccaacgcccccaucgggaagugcaacucggagugcaucaccccgaacggcuccauccccaacgacaagcccuuccagaacgugaaccgcaucacguacggcgccugcccccgguacgucaagcagaacacccugaagcuggccaccgggaugcgcaacgugccggagaagcagacccggggcaucuucggggccaucgccggcuucaucgagaacgggugggagggcaugguggacggcugguacggguuccgccaccagaacagcgagggcacggggcaggccgcggaccucaaguccacccaggccgccaucaaccagaucaacggcaagcugaaccggcugaucgagaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacacgaucgaccugaccgacucggagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 589 - RNA, 1701 nt, Artificial Sequence; identical to SEQ ID NO: 317
  derived and/or modified CDS sequence (AUadapt) from InfluenzaA__ABA42542__HA

SEQ ID NO: 590 - RNA, 1701 nt, Artificial Sequence
  derived and/or modified CDS sequence (AUadapt) from InfluenzaA__ABA42553__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggcccacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucucgucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 591 - RNA, 1701 nt, Artificial Sequence; identical to SEQ ID NO: 317
  derived and/or modified CDS sequence (AUadapt) from InfluenzaA__ABA42564__HA

SEQ ID NO: 592 - RNA, 1701 nt, Artificial Sequence
  derived and/or modified CDS sequence (AUadapt) from InfluenzaA__ABA42928__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcuccaagaucagcaucuacuggaccaucgugaagcccggcgacauccuccugaucaacuccaccggcaaccugaucgcgccccggggguacuucaagauccggucgggcaaguccagcaucaugcgcuccaacgccccgaucgggaagugcaacucggagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcauggugaacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucucggaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 593 - RNA, 1701 nt, Artificial Sequence; identical to SEQ ID NO: 317
  derived and/or modified CDS sequence (AUadapt) from InfluenzaA__ABA42939__HA

SEQ ID NO: 594 - RNA, 1701 nt, Artificial Sequence
  derived and/or modified CDS sequence (AUadapt) from InfluenzaA__ABA42978__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgauccccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 595 - RNA, 1701 nt, Artificial Sequence; identical to SEQ ID NO: 488
  derived and/or modified CDS sequence (AUadapt) from InfluenzaA__ABA43167__HA

SEQ ID NO: 596 - RNA, 1701 nt, Artificial Sequence
  derived and/or modified CDS sequence (AUadapt) from InfluenzaA__ABA43178__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcaucgcccugcucggguucaucaugugggccugccagaagggcaacauccggugcaacaucugcaucuga

SEQ ID NO: 597 - RNA, 1698 nt, Artificial Sequence
  derived and/or modified CDS sequence (AUadapt) from InfluenzaA__ABA43189__HA
augaaggccaagcugcucgugcugcugugcaccuucaccgccacguacgcggacaccaucugcgucggcuaccacgccaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgucaccggcguguccgccagcugcucccacaacggcaagagcuccuucuaccgcaaccugcuguggcucaccgggaagaacgggcuguaccccaaccugagcauguccuacgugaacaacaaggagaaggagguccucgugcuguggggcgugcaccacccgcccaacaucggcgaccagcgggcccuguaccacacggagaacgccuacgucagcguggugagcucccacuacucgcgccgguucacccccgagaucgccaagcgccccaagguccgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggucaacagcgugaucgagaagaugaacacccaguucacggccgucggcaaggaguucaacaagcuggagcgccggauggagaaccucaacaagaagguggacgacggguuccuggacaucuggaccuacaacgccgagcugcucgugcugcuggagaacgagcgcacccucgacuuccacgacucgaacgucaagaaccuguacgagaaggugaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgucaagcuggaguccauggggguguaccagauccuggccaucuacagcacgguggccagcucccucguccugcuggugagccucggcgccaucuccuucuggaugugcagcaacgggucccugcagugccgcaucugcaucuga

SEQ ID NO: 598 - RNA, 1701 nt, Artificial Sequence
  derived and/or modified CDS sequence (AUadapt) from InfluenzaA__ABA43200__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcagccagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccuggugguccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccagaucaagggcguggagcugaaguccggcuacaaggacuggauccuguggaucagcuucgccaucuccugcuuccuccugugcgucgugcugcucggguucaucaugugggccugccagaagggcaacauccggugcaacaucugcaucuga

SEQ ID NO: 599 - RNA, 1701 nt, Artificial Sequence
  derived and/or modified CDS sequence (AUadapt) from InfluenzaA__ABA43336__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagaacagcuccaccgggcgcaucugcgacucgccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaucaacgaggacuucaacuggaccgggguggcccaguccggcgggucguacgccugcaagcgcggcuccgugaacagcuucuucucccggcugaacuggcuccacgagucggaguacaaguaccccgcgcugaacgucaccaugcccaacaacgggaaguucgacaagcuguacguguggggcgugcaccaccccaucaccgaccgcgagcagacgaagcucuacguccgggccuccggccgcgugaccgugagcaccaagcggucccagcagaccgucaucccgaacaucgggucgcgccccugggugcggggccugagcucccgcaucucgaucuacuggacgaucgugaagcccggggacauccugcucaucaacuccaccggcaaccugaucgcgccccggggcuacuucaagauccgcaccggcaagagcuccaucaugcggucggacgccccgaucgggaccugcuccagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggcgccaucgccggguucaucgagaacggcugggaggggauggucgacggcugguacggguuccgccaccagaacucggagggcaccggccaggccgccgaccugaaguccacccaggcggccaucgaccagaucaacgggaagcugaaccggcucaucgagaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacucggagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaagggcgucgagcucaagagcggguacaaggacuggauccuguggaucuccuucgccaucagcugcuuccugcugugcguggugcugcucggcuucaucaugugggccugccagaaggggaacauccggugcaacaucugcaucuga

SEQ ID NO: 600 - RNA, 1707 nt, Artificial Sequence
  derived and/or modified CDS sequence (AUadapt) from InfluenzaA__ABA54915__HA
auggagaaggugguccugcuccuggccaccgccucgcuggugaaguccgaccagaucugcaucggcuaccacgcgaacaacucgaccgagcaggucgacacgaucauggagaagaacgugaccgugacccacgcccaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccucccccgccaacgaccugugcuaccccggggacuucaacgacuacgaggagcugaagcaccuccugagccggaucaaccacuucgagaagauccagaucaucccgaaguccucgugguccaaccacgaggcgucguccggcgucagcgccgccugccccuaccacggcaagcccuccuucuuccgcaacgugguguggcugaucaagaagaacucggccuaccccacgaucaagcgguccuacaacaacaccaaccaggaggaccuccugguccugugggggauccaccacccgaacgacgcggccgagcagaccaagcucuaccagaaccccaccacguacaucucggugggcaccuccacccugaaccagcgccuggugcccaagaucgccacccggagcaaggucaacgggcaguccggccgcauggaguucuucuggacgauccucaagcccaacgacgccaucaacuucgagucgaacgggaacuucaucgccccggaguacgcguacaagaucgugaagaagggcgacucggccaucaugaaguccgagcuggaguacggcaacugcaacaccaagugccagacccccaugggggccaucaacagcuccaugcccuuccacaacauccacccccugaccaucggcgagugcccgaaguacgucaagucgaaccggcucgugcuggccacggggcugcgcaacacgccccagcgggagcgccggcgcaagaagcggggccucuucggcgccaucgcgggguucaucgagggcggguggcagggcaugguggacgggugguacggcuaccaccacuccaacgagcagggcucgggguacgccgccgacaaggaguccacccagaaggccaucgacggcgugaccaacaaggucaacagcaucaucgacaagaugaacacccaguucgaggccguggggcgcgaguucaacaaccuggagcggcgcaucgagaaccugaacaagaagauggaggacggcuuccucgacguguggaccuacaacgcggagcugcugguccucauggagaacgagcggacccuggacuuccacgacuccaacgugaagaaccuguacaacaagguccgccuccagcugcgggacaacgccaaggagcuggggaacggcugcuucgaguucuaccacaagugcgacaacgagugcauggagucggugaagaacggcaccuacgacuacccccaguacuccgaggaggcccgccucaaccgggaggagaucucgggggugaagcuggaguccaugggcacguaccagauccugagcaucuacuccaccgucgccucgucccucgcccuggcgaucaugguggccgggcugucgcucuggaugugcuccaacggcagccugcagugccgcaucugcaucuga

SEQ ID NO: 601 - RNA, 1698 nt, Artificial Sequence
  derived and/or modified CDS sequence (AUadapt) from InfluenzaA__ABA87080__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucaucgagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgugaccggggucuccgccagcugcucccacaacggcaagucguccuucuaccgcaaccugcuguggcucaccgggaagaacggccuguaccccaaccugagcaaguccuacgccaacaacaaggagaaggaggugcucgugcuguggggcguccaccacccgcccaacaugggggaccagcgggcccuguaccacacggagaacgccuacgugagcguggucagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggugaccgggcuccggaacauccccuccauccagucgcgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagucgaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 602 - RNA, 1698 nt, Artificial Sequence; identical to SEQ ID NO: 541
  derived and/or modified CDS sequence (AUadapt) from InfluenzaA__ABA87091__HA

SEQ ID NO: 603 - RNA, 1698 nt, Artificial Sequence; identical to SEQ ID NO: 541
  derived and/or modified CDS sequence (AUadapt) from InfluenzaA__ABA87231__HA

SEQ ID NO: 604 - RNA, 1701 nt, Artificial Sequence; identical to SEQ ID NO: 500
  derived and/or modified CDS sequence (AUadapt) from InfluenzaA__ABA87242__HA

SEQ ID NO: 605 - RNA, 1701 nt, Artificial Sequence; identical to SEQ ID NO: 501
  derived and/or modified CDS sequence (AUadapt) from InfluenzaA__ABA87253__HA

SEQ ID NO: 606 - RNA, 1698 nt, Artificial Sequence
  derived and/or modified CDS sequence (AUadapt) from InfluenzaA__ABB02781__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucucgguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcgugugcaucuga

SEQ ID NO: 607 - RNA, 1698 nt, Artificial Sequence; identical to SEQ ID NO: 546
  derived and/or modified CDS sequence (AUadapt) from InfluenzaA__ABB02792__HA

SEQ ID NO: 608 - RNA, 1698 nt, Artificial Sequence; identical to SEQ ID NO: 544
  derived and/or modified CDS sequence (AUadapt) from InfluenzaA__ABB02803__HA

SEQ ID NO: 609 - RNA, 1698 nt, Artificial Sequence
  derived and/or modified CDS sequence (AUadapt) from InfluenzaA__ABB02814__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucggcaacgggugcuucgaguucuaccacaagugcgacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 610 - RNA, 1698 nt, Artificial Sequence
  derived and/or modified CDS sequence (AUadapt) from InfluenzaA__ABB02825__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucggcaacgggugcuucgaguucuaccacaagugcgacaacgagugcauggagagcgugaagaacggcaccuacgacuaccccaaguacuccgaggagagcaagcucaaccgggagcgcaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 611 - RNA, 1701 nt, Artificial Sequence
  derived and/or modified CDS sequence (AUadapt) from InfluenzaA__ABB02836__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcaaccagcagaccgugaucccgaacaucggcucgcggccccgcguccgggacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaagucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 612 - RNA, 1701 nt, Artificial Sequence
  derived and/or modified CDS sequence (AUadapt) from InfluenzaA__ABB02847__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaucggcgugacccagaacgggaccuccagcgccugcaagcgccgguccaacaacucguucuucucccgccugaacuggcucacccaccugaaguucaaguaccccgcccugaacgugacgaugcccaacaacgagaaguucgacaagcucuacaucuggggcguccaccaccccgggaccgacaacgaccagaucagccuguacgcgcaggccuccggccggaucaccgugucgaccaagcgcagccagcagacggugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggagcgacgcccccaucggcaagugcaacuccgagugcaucacccccaacgggucgauccccaacgacaagccguuccagaacgugaaccgcaucacguacggcgccugcccccgguacgucaagcagaacacccugaagcucgcgaccgggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacgcaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 613 - RNA, 1701 nt, Artificial Sequence; identical to SEQ ID NO: 292
  derived and/or modified CDS sequence (AUadapt) from InfluenzaA__ABB02858__HA

SEQ ID NO: 614 - RNA, 1701 nt, Artificial Sequence
  derived and/or modified CDS sequence (AUadapt) from InfluenzaA__ABB02869__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucguggagaacgggugggagggcauggucgacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 615 - RNA, 1701 nt, Artificial Sequence
  derived and/or modified CDS sequence (AUadapt) from InfluenzaA__ABB02880__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaaccggaagcucaaccgccugaucgagaagaccaacgagaaguuccaccagaucgagaaggaguucucggaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacauggggaacggcugcuucaagaucuaccacaagugcgacaacgccugcaucggcuccauccgcaacgggaccuacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaaggggaacauccggugcaacaucugcaucuga

SEQ ID NO: 616 - RNA, 1701 nt, Artificial Sequence
  derived and/or modified CDS sequence (AUadapt) from InfluenzaA__ABB02891__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgucgcuccgcucccugguggccagcuccggcacccuggaguucaacaacgagucguucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucagcuccaucaucucgaucuacuggaccaucgugaagcccggcgacauccuccugaucaacuccaccggcaaccugaucgcgccccggggguacuucaagauccggagcggcaaguccucgaucaugcgcuccaacgccccgaucggggagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucucggaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 617 - RNA, 1701 nt, Artificial Sequence
  derived and/or modified CDS sequence (AUadapt) from InfluenzaA__ABB02902__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugauggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggguucaucaugugggccugccagaagggcaacauccgcugcaacaucugcaucuga

SEQ ID NO: 618 - RNA, 1698 nt, Artificial Sequence
  derived and/or modified CDS sequence (AUadapt) from InfluenzaA__ABB02913__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccggcccccgaacaucggcgaccagcgcgcccuguaccacacggagaacgccuacgugagcgucgugagcucccacuacucgcggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaaccggaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 619 - RNA, 1698 nt, Artificial Sequence
  derived and/or modified CDS sequence (AUadapt) from InfluenzaA__ABB02924__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccucgugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacgccgucaucgagaagaugaacacccaguucacggccguggggaaggaguucaacaagcuggagcggcgcauggagaaccucaacaagaaggucgacgacggcuuccuggacaucuggaccuacaacgcggagcugcucgugcugcuggagaacgagcggacccucgacuuccacgacucgaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccacgguggccucgagccucgugcugcuggucucccucggggccaucagcuucuggaugugcuccaacggcagccugcagugccggaucugcaucuga

SEQ ID NO: 620 - RNA, 1698 nt, Artificial Sequence
  derived and/or modified CDS sequence (AUadapt) from InfluenzaA__ABB02936__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggccacuucgccgacuacgaggagcugcgcgagcagcucuccagcguguccucguucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugucggucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcucggccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagucgaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 621 - RNA, 1701 nt, Artificial Sequence
  derived and/or modified CDS sequence (AUadapt) from InfluenzaA__ABB02947__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugcaggacuacgcgucgcugcggucccucgucgccagcuccggcacgcuggaguucaacaacgagucguucaacuggaccgggguggcccagaacggcaccuccuacgccugcaagcgccggagcaucaaguccuucuucucgcgccugaacuggcuccaccagcugaaguacaaguacccggcgcugaacgugaccaugcccaacaacgacaaguucgacaagcucuacaucuggggcguccaccaccccuccacggacagcgaccagaccucccuguacgcccaggccucggggcgggugaccgugagcaccaagcgcucccagcagacggucauccccaacaucgggucgcggccgugggugcgcggcguguccagccggaucuccaucuacuggaccaucgucaagcccggcgacauccugcucaucaacucgaccgggaaccugaucgcgccccgcggcuacuucaagauccgguccgggaaguccuccaucaugcgcagcgacgcccccaucggcaagugcaacuccgagugcaucaccccgaacggcucgauccccaacgacaagcccuuccagaacgugaaccggaucacguacggggccugcccccgcuacgugaagcagaacacccugaagcucgccaccggcaugcggaacgucccggagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucucguucgccaucagcugcuuccuccugugcgugguccugcucggcuucaucaugugggccugccagaagggcaacauccggugcaacaucugcaucuga

SEQ ID NO: 622 - RNA, 1701 nt, Artificial Sequence; identical to SEQ ID NO: 431
  derived and/or modified CDS sequence (AUadapt) from InfluenzaA__ABB02958__HA

SEQ ID NO: 623 - RNA, 1701 nt, Artificial Sequence; identical to SEQ ID NO: 431
  derived and/or modified CDS sequence (AUadapt) from InfluenzaA__ABB02969__HA

SEQ ID NO: 624 - RNA, 1701 nt, Artificial Sequence
  derived and/or modified CDS sequence (AUadapt) from InfluenzaA__ABB02980__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucguccaucaucagcaucuacuggacgaucgucaagcccggcgacauccuccugaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggaccggccaggccgcggaccugaaguccacgcaggccgccaucaaccagaucaacgggaagcucaaccgccugaucgagaagaccaacgagaaguuccaccagaucgagaaggaguucucggagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 625 - RNA, 1701 nt, Artificial Sequence
  derived and/or modified CDS sequence (AUadapt) from InfluenzaA__ABB02991__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacaacccccaccagauccuggacggcgagaacugcacccugaucgacgcccuccugggggacccccacugcgacggcuuccagaacaaggagugggaccuguucguggagcgguccaaggccuacucgaacugcuaccccuacgacgugccggacuacgcgucccuccgcagccuggucgccuccucgggcacgcuggaguucaacaacgaguccuucaacuggaccgggguggcccagaacggcaccagcuccgccugcaagcggcgcucgaacaaguccuucuucagccggcucaacuggcugcaccagcugaaguacaaguaccccgcgcucaacgugaccaugcccaacaacgagaaguucgacaagcuguacaucuggggcguccaccaccccuccacggacucggaccagaucucccuguacgcccaggccagcgggcgcgugaccgugucgaccaagcggucccagcagaccgucaucccgaacaucgggagccgccccugggugcggggcguguccucgaucaucuccaucuacuggacgaucgucaagcccggcgacauccuccugaucaacagcaccgggaaccugaucgcgccccgcggcuacuucaagauccgguccggcaagucguccaucaugcgcagcgacgccccgaucgggaagugcaacuccgagugcaucacccccaacggcucgauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacaugggcaacgggugcuucaagaucuaccacaagugcgacaacgccugcaucggcagcauccgcaacgggaccuacgaccacgacguguaccgcgacgaggcccugaacaaccgguuccagaucaagggcgucgagcugaaguccggguacaaggacuggauccucuggaucucguucgccaucagcugcuuccugcugugcgugguccuccugggcuucaucaugugggccugccagaagggcaacauccgcugcaacaucugcaucuga

SEQ ID NO: 626 - RNA, 1701 nt, Artificial Sequence
  derived and/or modified CDS sequence (AUadapt) from InfluenzaA__ABB03002__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcaacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucggguccggccccugggugcgcggcgugagcucccggaucucgaucuacuggacgaucgucaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacucggagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 627 - RNA, 1701 nt, Artificial Sequence
  derived and/or modified CDS sequence (AUadapt) from InfluenzaA__ABB03013__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccucggaccagaucgaggugacgaacgccaccgagcucguccaguccagcuccaccgggcgcaucugcgacucgccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggucgcuggucgccuccagcggcacgcuggaguucaacaacgaguccuucaacuggaccgggguggcccagaacggcaccucguucgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccgggacggacucggaccagaccucccuguacgcccaggccagcgggcgggugaccgugucgaccaagcgcucccagcagacggucaucccgaacaucggcucgggccccugggugcgcgggguguccagccggaucuccaucuacuggaccaucgucaagcccggcgacauccuccugaucaacucgaccgggaaccugaucgcgccccggggcuacuucaagauccgcuccggcaagagcuccaucaugcggucggacgccccgaucgggaagugcaacuccgagugcaucacccccaacggcagcauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggcuucaucgagaacgggugggagggcaugguggacgggugguacggcuuccgccaccagaacuccgaggggacgggccaggccgcggaccucaagucgacccaggccgccaucaaccagaucaacggcaagcugaaccggcugaucgagaagaccaacgagaaguuccaccagaucgagaaggaguucaccgagguggaggggcgcauccaggaccuggagaaguacgucgaggacacgaagaucgaccucugguccuacaacgccgagcugcugguggcccucgagaaccagcacaccaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggacguacgaccacgacguguaccgcgacgaggcccugaacaaccgguuccagaucaagggcgucgagcucaagucgggcuacaaggacuggauccuguggaucuccuucgccaccagcugcuuccugcugugcgugguccuccugggguucaucaugugggccugccagaagggcaacauccgcugcaacaucugcaucuga

SEQ ID NO: 628 - RNA, 1701 nt, Artificial Sequence
  derived and/or modified CDS sequence (AUadapt) from InfluenzaA__ABB03024__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccuggauccggggcgugagcucccgcaucucgaucuacuggacgaucgugaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacgcucaagcuggccaccggcaugcgcaacgugcccgagaagcagacccgggggaucuucggcgccaucgccggguucaucgagaacggcugggagggcauggucgacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaagggcaacauccggugcaacaucugcaucuga

SEQ ID NO: 629 - RNA, 1701 nt, Artificial Sequence
  derived and/or modified CDS sequence (AUadapt) from InfluenzaA__ABB03035__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccucggaccagaucgaggugacgaacgccaccgagcucguccaguccagcuccaccgggcgcaucugcgacucgccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggucgcuggucgccuccagcggcacgcuggaguucaacaacgaguccuucaacuggaccgggguggcccagaacggcaccucguucgccugcaagcgccgguccaucaagagcuucuucucccgccucaacuggcugcaccagcugaaguacaaguaccccgcgcucaacguggccaugcccaacaacgacaaguucgacaagcuguacaucuggggcguccaccaccccgggaccgacucggaccagacgucccuguacgcccaggccagcgggcgggugaccgugucgaccaagcgcucccagcagaccgucaucccgaacaucggcucgcggcccugggugcgcggcguguccagccggaucuccaucuacuggacgaucgucaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggcggccgaccucaagucgacgcaggccgccaucaaccagaucaacggcaagcugaaccgccugaucgagaagaccaacgagaaguuccaccagaucgagaaggaguucaccgagguggagggccggauccaggaccuggagaaguacgucgaggacaccaagaucgaccucugguccuacaacgccgagcugcugguggcgcucgagaaccagcacacgaucgaccugaccgacagcgagaugaacaagcuguucgagcgcacccgcaagcagcuccgggagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagucgggcuacaaggacuggauccuguggaucuccuucgccacgagcugcuuccugcugugcgugguccuccugggcuucaucaugugggcgugccagaaggggaacauccggugcaacaucugcaucuga

SEQ ID NO: 630 - RNA, 1701 nt, Artificial Sequence
  derived and/or modified CDS sequence (AUadapt) from InfluenzaA__ABB03046__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucguccggcaucucgaucuacuggacgaucgucaagcccggggacauccuccugaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacucggagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggcccuccugggcuucaucaugugggcgugccagaaggggaacauccgcugcaacaucugcaucuga

SEQ ID NO: 631 - RNA, 1701 nt, Artificial Sequence
  derived and/or modified CDS sequence (AUadapt) from InfluenzaA__ABB03057__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaccucgcuguacgcgcaggccuccggccggaucacggugagcaccaagcgcucgcagcagaccgugaucccgaacaucggcucccggccccgcguccgggacauccccucgcgcaucuccaucuacuggaccaucgugaagcccggggacauccugcucaucaacagcacgggcaaccugaucgccccgcggggguacuucaagauccgcuccggcaagucguccaucaugcggucggacgcccccaucggcaagugcaacuccgagugcaucacccccaacgggagcauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaagcugggcuacaaggacuggauccucuggaucuccuucgccaucagcugcuuccugcugugcguggcccuccugggguucaucaugugggccugccagaagggcaacauccggugcaacaucugcaucuga

SEQ ID NO: 632 - RNA, 1701 nt, Artificial Sequence; identical to SEQ ID NO: 531
  derived and/or modified CDS sequence (AUadapt) from InfluenzaA__ABB03068__HA

SEQ ID NO: 633 - RNA, 1701 nt, Artificial Sequence; identical to SEQ ID NO: 488
  derived and/or modified CDS sequence (AUadapt) from InfluenzaA__ABB03079__HA

SEQ ID NO: 634 - RNA, 1701 nt, Artificial Sequence; identical to SEQ ID NO: 488
  derived and/or modified CDS sequence (AUadapt) from InfluenzaA__ABB03090__HA

SEQ ID NO: 635 - RNA, 1698 nt, Artificial Sequence
  derived and/or modified CDS sequence (AUadapt) from InfluenzaA__ABB03101__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaagaaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucucgguggugagcucccacuacagccgccgguucacccccgagaucaccaagcgccccaagguccgggaccaggagggccgcaucaacuacuacuggacccuccuggagcccggggacacgaucaucuucgagaccaacggcaaccugaucgccccgugguacgcguucgcccucucccggggguucggcagcggcaucaucaccuccaacgcccccauggacgagugcgacgccaagugccagacgccccagggggccaucaacagcucccugcccuuccagaacgugcacccggugaccaucggcgagugccccaaguacguccgcucggcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgucaagcuggacuccaugggcguguaccagauccuggccaucuacagcaccguggcgagcucccucguccugcuggugagccucggggccaucuccuucuggaugugcagcaacggcucccugcagugccgcaucugcaucuga

SEQ ID NO: 636 - RNA, 1701 nt, Artificial Sequence
  derived and/or modified CDS sequence (AUadapt) from InfluenzaA__ABB03112__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaacaagaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacacgugcaucgagagcauccgcaacggcaccuacgaccacgacguguaccgcgacgaggcgcucaacaaccgguuccagaucaaggggguggagcugaaguccggcuacaaggacuggauccuguggaucucguucgccaucagcugcuuccuccugugcgucgcccugcucggcuucaucaugugggccugccagaaggggaacauccgcugcaacaucugcaucuga

SEQ ID NO: 637 - RNA, 1698 nt, Artificial Sequence
  derived and/or modified CDS sequence (AUadapt) from InfluenzaA__ABB03123__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuucgugaaccugcuggaggacucccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgcgagcagcucagcuccgugagcuccuucgagcgguucgagaucuucccgaaggagucguccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugucgagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccucgauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 638 - RNA, 1698 nt, Artificial Sequence
  derived and/or modified CDS sequence (AUadapt) from InfluenzaA__ABB03134__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgagaagaacgggcuguaccccacgcugagcaaguccuacgccaacaacaaggagaaggaggugcucauccuguggggcgugcaccacccgcccaacaucggggaccagcggacccuguaccacaccgagaacgccuacgucucgguggugagcucccacuacagccgccgguucacccccgagaucacgaagcgccccaagguccgggaccaggagggccgcaucaacuacuacuggacccuccuggagcccggcgacaccaucaucuucgaggccaacgggaaccugaucgccccgugguacgcguucgcccucucccggggcuucgggagcggcaucaucaccuccaacgcccccauggacgagugcgacgccaagugccagacgccccagggcgccaucaacagcucccugcccuuccagaacgugcacccggugaccaucggggagugccccaaguacguccgcucggcgaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgccgaccagaaguccacgcagaacgcgaucaacggcaucaccaacaaggucaacagcgugaucgagaagaugaacacccaguucaccgccgugggcaaggaguucaacaagcuggagcgccggauggagaaccucaacaagaaggucgacgacggguuccuggacaucuggacguacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagucgaagcucaaccgggagaagaucgacggggucaagcuggaguccaugggcguguaccagauccuggccaucuacagcaccguggcgagcucccucguccugcuggugagccucggcgccaucuccuucuggaugugcagcaacgggucccugcagugccgcaucugcaucuga

SEQ ID NO: 639 - RNA, 1698 nt, Artificial Sequence; identical to SEQ ID NO: 544
  derived and/or modified CDS sequence (AUadapt) from InfluenzaA__ABB03145__HA

SEQ ID NO: 640 - RNA, 1701 nt, Artificial Sequence
  derived and/or modified CDS sequence (AUadapt) from InfluenzaA__ABB04283__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgucgcugcggucccucgucgccagcuccggcacgcuggaguucaucaacgagggguucaacuggaccggcgugacccagucggggggcuccuacgccugcaagcgcgggagcgacaaguccuucuucagccggcugaacuggcucuacgaguccgagucgaaguaccccgcccugaacgugaccaugcccaacaacggcaacuucgacaagcuguacaucuggggcguccaccaccccuccacggacaaggagcagaccaaccucuacgugcgcgcgagcgggcgggugaccgucucgaccaagcgcucccagcagacgaucaucccgaacaucggcccccggcccugggugcgcgggcugagcucccggaucucgaucuacuggaccaucgugaagcccggcgacauccugcucaucaacuccagcggcaaccugaucgccccgcgcggguacuucaagauccggaccggcaaguccagcaucaugcgcuccgacgcccccaucgggaccugcucguccgagugcaucacgcccaacggcagcauccccaacgacaagccguuccagaacgucaacaagaucaccuacggggccugccccaaguacgugaagcagaacacccugaagcucgccaccggcaugcggaacauccccgagaagcagacgcgcggcaucuucggggcgaucgccggcuucaucgagaacgggugggagggcaugguggacgggugguacggcuuccggcaccagaacuccgagggcaccgggcaggccgccgaccucaagucgacccaggccgcgaucgaccagaucaacggcaagcugaaccgcgucaucgagaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagacccgccggcagcugcgcgagaacgccgaggacaugggcaacgggugcuucaagaucuaccacaagugcgacaacgccugcaucggcucgauccgcaacggcacguacgaccacgacguguaccgggacgaggcgcugaacaaccgcuuccagaucaaggggguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 641 - RNA, 1701 nt, Artificial Sequence
  derived and/or modified CDS sequence (AUadapt) from InfluenzaA__ABB04294__HA
augaagaccaucaucgcccugucguacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccucgaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgugccggacuacgccucccuccgcucgcuggucgcguccagcgggacgcuggaguucaucaacgagggcuucaacuggaccggggugacccagaacggcggguccaacgccugcaagcggggccccgacucgggcuucuucucccgccucaacuggcuguacaagagcggguccaccuaccccgugcugaacgucacgaugcccaacaacgacaacuucgacaagcucuacaucuggggcgugcaccacccgucgaccgaccaggagcagaccaaccuguacgugcaggccuccgggcgggucaccgugagcacgaagcgcucccagcagaccaucauccccaacaucggcucgcggcccugggugcgcggccugagcucccggaucucgaucuacuggaccaucgucaagcccggggacauccucgugaucaacuccaacggcaaccugaucgccccgcgcggguacuucaagaugcggaccggcaagagcuccaucaugcgcucggacgcgcccaucgggacgugcaucuccgagugcaucacccccaacggcagcauccccaacgacaagccguuccagaacgugaacaagaucaccuacggcgccugccccaaguacgucaagcagaacacccugaagcucgccacggggaugcggaacgugcccgagaagcagacccgcggcaucuucggggccaucgccggcuucaucgagaacgggugggagggcaugaucgacggcugguacggguuccggcaccagaacuccgagggcaccgggcaggcggccgaccucaagucgacccaggccgccaucgaccagaucaacggcaagcugaaccgcgugaucgagaagacgaacgagaaguuccaccagaucgagaaggaguucuccgaggucgaggggcggauccaggaccucgagaaguacguggaggacaccaagaucgaccuguggagcuacaacgccgagcugcucguggcgcuggagaaccagcacaccaucgaccugaccgacuccgagaugaacaagcuguucgagaagacgcgccggcagcugcgcgagaacgccgaggacaugggcaacggcugcuucaagaucuaccacaagugcgacaacgccugcaucgggucgauccggaacggcaccuacgaccacgacgucuaccgcgacgaggcccugaacaaccgcuuccagaucaaggggguggagcucaaguccggcuacaaggacuggauccuguggaucagcuucgccaucuccugcuuccugcucugcgucgugcugcugggcuucaucaugugggcgugccagaaggggaacauccggugcaacaucugcaucuga

SEQ ID NO: 642 - RNA, 1701 nt, Artificial Sequence
  derived and/or modified CDS sequence (AUadapt) from InfluenzaA__ABB04305__HA
augaagaccaucaucgcccugucguacaucuucugccucguguucgcccagaagcugcccgagaacgacaacuccaccgcgacgcugugccucggccaccacgccgucccgaacgggacccuggugaagaccaucaccaacgaccagaucgaggugacgaacgccaccgagcugguccagagcuccucgaccggccgcaucugcgacagcccccaccggauccucgacgggaagaacugcacccugaucgacgcccugcucggcgacccccacugcgacggguuccagaacgagaagugggaccuguucguggagcgcagcaaggccuucuccaacugcuaccccuacgacgugccggacuacgcgucgcugcggucccucgucgccagcuccggcacgcuggaguucaucaacgagggcuucaacuggaccggggugacccagagcggcggguccuacgccugcaagcgcggcucggugaacuccuucuucagccggcugaacuggcucuacaaguccgagagcaaguaccccguccugaacgugaccaugcccaacaacgggaaguucgacaagcuguacaucuggggcgugcaccaccccuccacggacaaggagcagaccaaccucuacguccgcgccucgggcaaggugaccgugagcaccaagcggucccagcagacggucaucccgaacaucgggagccgccccugggugcggggccuguccucgcgcaucuccaucuacuggaccaucgugaagcccggggacauccugcucaucaacagcaccggcaaccugaucgcgccccggggcuacuucaagauccgcaccgggaaguccagcaucaugcgguccgacgccccgaucggcacgugcucguccgagugcaucacccccaacgggagcauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgcgggguucaucgagaacggcugggaggggauggucgacggcugguacggguuccggcaccagaacuccgagggcaccggccaggccgccgaccugaaguccacccaggccgccaucgaccagaucaacgggaagcugaaccgccucaucgagaagacgaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgcaagcagcugcgggagaacgccgaggacauggggaacggcugcuucaagaucuaccacaagugcgacaacgccugcaucgggucgauccgcaacggcaccuacgaccacgacguguaccgcgacgaggcccucaacaaccgguuccagaucaagggcgucgagcugaaguccggguacaaggacuggauccuguggaucagcuucgcgaucagcugcuuccuccugugcguggugcugcucggcuucaucaugugggccugccagaaggggaacauccgcugcaacaucugcaucuga

SEQ ID NO: 643 - RNA, 1701 nt, Artificial Sequence
  derived and/or modified CDS sequence (AUadapt) from InfluenzaA__ABB04316__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccucguccggcacgcuggaguucaucaacgaggacuucaacuggaccggggugacccagagcggcggguccuacgccugcaagcgcggcucggugaaguccuucuucagccggcugaacuggcuccacgaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugucgaccaagcggagccagcagacggugaucccgaacaucgggucccgccccuggguccggggccugucgucccgcaucagcaucuacuggaccaucgugaagcccggggacauccugcucaucaacuccaccggcaaccugaucgcgccccggggcuacuucaagauccgcaccgggaaguccuccaucaugcggucggacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacucggagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacucggagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaagaacuggauccuguggaucuccuucgccaucagcugcuuccugcugugcgucgugcugcucggcuucaucaugugggccugccagaaggggaacauccgcugcaacaucugcaucuga

SEQ ID NO: 644 - RNA, 1701 nt, Artificial Sequence
  derived and/or modified CDS sequence (AUadapt) from InfluenzaA__ABB04327__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacucgccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccucguccggcacgcuggaguucaucaacgagggguucaacuggaccggcgugacccagagcgggggcuccuacgccugcaagcgcgggagcgugaacuccuucuucucgcggcugaacuggcucuacaaguccgaguacaaguaccccgcccugaacgucaccaugcccaacaacggcaaguucgacaagcuguacaucuggggcgugcaccaccccagcacggagaaggagcagaccaaccucuacgugcgcgcguccgggcgggucaccgugagcaccaagcgcucgcagcagacggugaucccgaacaucggcuccauccccuggguccgggggcugagcucccgcaucagcaucuacuggaccaucgugaagcccggcgacauccugcucaucaacuccaccggcaaccugaucgcgccccggggguacuucaagauccgcaccggcaagucguccaucaugcggagcgacgccccgaucgggacgugcuccagcgagugcaucacccccaacggcuccauccccaacgacaagcccuuccagaacgugaacaagaucaccuacggggccugcccgcgcuacgucaagcagaacacccugaagcucgccacgggcaugcggaacgugcccgagaagcagacccgcggcaucuucggggccaucgccggcuucaucgagaacgggugggagggcaugguggacgggugguacggcuuccggcaccagaacucggagggcaccgggcaggccgccgaccugaaguccacccaggccgcgaucgaccagaucaacggcaagcugaaccgccucaucgagaagacgaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgggagaacgccgaggacaugggcaacgggugcuucaagaucuaccacaagugcgacaacgccugcaucggcuccauccgcaacggcaccuacgaccacgacgucuaccgcgacgaggcgcucaacaaccgguuccagaucaaggggguggagcugaaguccggcuacaaggacuggauccuguggaucuccuucgccaucagcugcuuccuccugugcgucgugcugcucggguucaucaugugggccugccagaagggcaacauccgcugcaacaucugcaucuga

SEQ ID NO: 645 - RNA, 1701 nt, Artificial Sequence
  derived and/or modified CDS sequence (AUadapt) from InfluenzaA__ABB04338__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaacgagggcuucaccuggaccggggugacgcagaacggcggguccaacgccugcaagcggggccccgacagcggcuucuucucccgccugaacuggcucuacaagucgggguccaccuaccccgugcugaacgucaccaugcccaacaacgacaacuucgacaagcuguacaucuggggcgugcaccacccgagcaccgaccaggagcagacgucccucuacgugcaggccucggggcgggucaccguguccaccaagcgcagccagcagaccaucauccccaacaucggcucgcggcccugggugcgcggccuguccagccggaucuccaucuacuggacgaucgucaagcccggggacauccuggugcucaacagcaacggcaaccugaucgccccgcgcggguacuucaagaugcggaccggcaaguccucgaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcucgccaccgggaugcggaacgugcccgagaagcagacccgcggccuguucggggccaucgccggcuucaucgagaacgggugggagggcaugaucgacggcugguacggguuccggcaccagaacucggagggcacggggcaggcggccgaccugaaguccacccaggccgccaucgaccagaucaacggcaagcucaaccgcgugaucgagaagaccaacgagaaguuccaccagaucgagaaggaguucagcgaggucgaggggcggauccaggaccuggagaaguacguggaggacaccaagaucgaccugugguccuacaacgccgagcuccugguggcgcuggagaaccagcacacgaucgaccucaccgacucggagaugaacaagcuguucgagaagacccgccggcagcugcgcgagaacgccgaggacaugggcaacggcugcuucaagaucuaccacaagugcgacaacgccugcaucggguccauccggaacggcaccuacgaccacgacgucuaccgcgacgaggcccucaacaaccgcuuccagaucaaggggguggagcucaagagcggcuacaaggacuggauccuguggaucuccuucgccaucagcugcuuccugcugugcgucgugcugcucggcuucaucaugugggcgugccagaaggggaacauccggugcaacaucugcaucuga

SEQ ID NO: 646 - RNA, 1701 nt, Artificial Sequence
  derived and/or modified CDS sequence (AUadapt) from InfluenzaA__ABB04349__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgucgcugcggucccucgucgccagcuccggcacgcuggaguucaucaacgagggguucaacuggaccggcgugacccagagcgggggcuccuacgccugcaagcgcgggucggugaacuccuucuucagccggcugaacuggcucuacaaguccgagagcaaguaccccguccugaacgugaccaugcccaacaacggcaaguucgacaagcuguacaucuggggcgugcaccaccccuccacggacaaggagcagaccaaccucuacguccgcgccucggggaaggugaccgugagcaccaagcggucccagcagacggucaucccgaacaucggcucgcgccccugggugcgggggcuguccagccgcaucuccaucuacuggaccaucgugaagcccggcgacauccugcucaucaacagcaccggcaaccugaucgcgccccggggguacuucaagauccgcaccggcaaguccucgaucaugcgguccgacgccccgaucgggacgugcaacagcgagugcaucacccccaacggcuccauccccaacgacaagcccuuccagaacgucaacaagaucaccuacggggccugcccgcgcuacgugaagcagaacacccugaagcucgccacgggcaugcggaacgugcccgagaagcagacccgcggcaucuucggggccaucgcgggcuucaucgagaacgggugggagggcauggucgacgggugguacggcuuccggcaccagaacagcgagggcaccgggcaggccgccgaccugaaguccacccaggccgccaucgaccagaucaacggcaagcugaaccgccucaucgagaagacgaacgagaaguuccaccagaucgagaaggaguucucggagguggaggggcggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgcaagcagcugcgggagaacgccgaggacaugggcaacgggugcuucaagaucuaccacaagugcgacaacgccugcaucggcuccauccgcaacggcaccuacgaccacgacguguaccgcgacgaggcccucaacaaccgguuccagaucaagggggucgagcugaaguccggcuacaaggacuggauccuguggaucuccuucgcgaucagcugcuuccuccugugcguggugcugcucggguucaucaugugggccugccagaagggcaacauccgcugcaacaucugcaucuga

SEQ ID NO: 647 - RNA, 1701 nt, Artificial Sequence
  derived and/or modified CDS sequence (AUadapt) from InfluenzaA__ABB04360__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccucguccggcacgcuggaguucaucaacgaggacuucaacuggaccggggugacccagagcggcggguccuacgccugcaagcgcggcucggugaacuccuucuucagccggcugaacuggcuccacaaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugucgaccaagcggagccagcagacggugaucccgaacaucgggucccgccccuggguccggggccugucgucccgcaucagcaucuacuggaccaucgugaagcccggggacauccugcucaucaacuccaccggcaaccugaucgcgccccggggcuacuucaagauccgcaccgggaaguccuccaucaugcggucggacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacucggagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacucggagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 648 - RNA, 1701 nt, Artificial Sequence
  derived and/or modified CDS sequence (AUadapt) from InfluenzaA__ABB04371__HA
augaagaccaucaucgcccugucguacaucuucuaccucgcccugggccaggaccugcccgggaacgacaacuccaaggcgacccucugccugggccaccacgccgugccgaacgggacgcuggucaagaccaucaccgacgaccagaccgaggugacgaacgccaccgagcucgugcagucguccagcaccggcaagaucugcaacaacccccaccgcauccuggacgggauggacugcacccugaucgacgcccuccugggcgacccccacugcgacgucuuccagaacgagacgugggaccuguucguggagcgguccaaggccuucucgaacugcuaccccuacgacgugccggacuacgcgucccuccgcucgcuggucgccuccagcggcaccauggaguucaucaccgagggguucaccuggacggaggugacccagaacggcggguccaacgccugcaagcggggccccgacucgggguucuucucccgccugaacuggcucaccaagucgggccggaccuaccccgugcugaacgucacgaugcccaacaacgacaacuucgacaagcuguacaucuggggcgugcaccacccguccaccgaccaggagcagaccaaccucuacgugcagaccagcgggcgcgucacgguguccacccggcgcucgcagcagaccaucauccccaacaucggcucccggcccugggugcgcgggcugucgagccggaucuccaucuacuggaccaucgucaagcccggcgacgugcuggugaucaacucgaacggcaaccucaucgccccgcgcggguacuucaagaugcggacgggcaaguccucgaucaugcgcuccgacgcgcccaucgacacgugcaucagcgagugcaucacccccaacggguccauccccaacgacaagccguuccagaacgucaacaagaucaccuacggcgccugccccaaguacgugaagcagaacacccugaagcuggccaccgggaugcggaacgugcccgagaagcagacccgcggccucuucggcgccaucgccggguucaucgagaacggcugggaggggaugaucgacggcugguacggguuccggcaccagaacucggagggcaccggccaggcggccgaccugaaguccacgcaggccgccaucgaccagaucaacgggaagcugaaccgcaucaucgagaagaccaacgagaaguuccaccagaucgagaaggaguucucggaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagacccgccggcagcuccgcgagaacgccgaggacauggggaacggcugcuucaagaucuaccacaagugcgacaacgccugcaucgaguccauccgcaacgggaccuacgaccacgacgucuaccgggacgaggcccugaacaaccgcuuccagaucaagggcguggagcucaagucgggcuacaaggacuggauccuguggaucuccuucgccaucagcugcuuccugcucugcgucgugcugcugggguucaucaugugggcgugccagcggggcaacauccgcugcaacaucugcaucuga

SEQ ID NO: 649 - RNA, 1701 nt, Artificial Sequence
  derived and/or modified CDS sequence (AUadapt) from InfluenzaA__ABB04906__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccagaacggcgacagcuacgccugcaagcgcggguccgugaaguccuucuucucccggcucaacuggcugcacaagucggaguacaaguaccccgcgcugaacgucaccaugcccaacaacgacaaguucgacaagcucuacaucuggggcgugcaccaccccuccaccgaccgcgagcagacgagccuguacauccgggccuccgggaaggugaccgucucgaccaagcgcagccagcagaccgugaucccgaacaucggcucccggcccugggugcgcggccugucgucccggaucagcaucuacuggacgaucgucaagcccggggacauccuccugaucaacuccaccggcaaccugaucgcgccccgcggguacuucaagauccggaccggcaagucguccaucaugcgcagcgacgccccgaucgggaccugcuccucggagugcaucacgcccaacggcuccauccccaacgacaagcccuuccagaacgugaaccggaucaccuacggcgccugcccgcgcuacgugaagcagaacacccucaagcuggccaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucgaccagaucaacggcaagcucaaccgccugaucgagaagaccaacgagaaguuccaccagaucgagaaggaguucucggagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcacguacgaccacgacguguaccgcgacgaggcccugaacaaccgguuccagaucaagggggucgagcucaagucgggcuacaaggacuggauccuguggaucuccuucgccaucagcugcuuccugcugugcgugguccuccugggcuucaucaugugggccugccagaaggggaacauccgcugcaacaucugcaucuga

SEQ ID NO: 650 - RNA, 1701 nt, Artificial Sequence
  derived and/or modified CDS sequence (AUadapt) from InfluenzaA__ABB04917__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagaucagcuccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucucgaacugcuaccccuacgacgugccggacuacgcgucccugcggagccucgucgccuccagcggcacgcuggaguucaucaacgagggguucaacuggaccggcgugacccaguccgggggcucguacacgugcaagcgcggguccgugaacagcuucuucucccggcugaacuggcucuacgagagcgaguccaaguaccccguccugaacgugaccaugcccaacaacggcaaguucgacaagcuguacaucuggggcgugcaccaccccucgaccgacaaggagcagaccaaccucuacguccgcgccuccgggcgggugaccgugagcacgaagcgcagccagcagaccgucaucccgaacaucggcucccggcccugggugcgcgggcugucgucccggaucagcaucuacuggaccaucgugaagcccggcgacauccugcucaucaacuccaccggcaaccugaucgcgccccgcggguacuucaagauccggacgggcaagagcuccaucaugcgcucggacgccccgaucgggaccugcuccagcgagugcaucacccccaacggcuccauccccaacgacaagcccuuccagaacgucaacaagaucaccuacggggccugcccgcgguacgugaagcagaacacgcugaagcucgccaccggcaugcgcaacgugcccgagaagcagacccggggcaucuucggggccaucgccggcuucaucgagaacgggugggagggcauggucgacgggugguacggcuuccgccaccagaacagcgagggcaccgggcaggcggccgaccugaaguccacgcaggccgccaucgaccagaucaacggcaagcugaaccggcucaucgagaagaccaacgagaaguuccaccagaucgagaaggaguucucggagguggaggggcgcauccaggaccuggagaaguacguggaggacaccaagaucgaccugugguccuacaacgccgagcuccuggucgcgcuggagaaccagcacaccaucgaccucacggacagcgagaugaacaagcuguucgagaagacccggaagcagcugcgcgagaacgccgaggacaugggcaacgggugcuucaagaucuaccacaagugcgacaacgccugcaucggcuccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggugcugcucggguucaucaugugggcgugccagaagggcaacauccggugcaacaucugcaucuga

SEQ ID NO: 651 - RNA, 1701 nt, Artificial Sequence
  derived and/or modified CDS sequence (AUadapt) from InfluenzaA__ABB04928__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcaacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaucggcgugacccagaacgggggcuccaacgccugcaagcgggggaccgacagcggcuucuucucccgccugaacuggcucuacaagucgggcuccaccuaccccgugcagaacgucacgaugcccaacaacgacaacagcgacaagcuguacaucuggggcgugcaccaccccuccaccgacaaggagcagaccgaccuguacgugcaggccucggggaaggucaccguguccacgaagcggagccagcagaccaucaucccgaacguggggucgcgccccuggguccggggccucuccagccgcaucuccaucuacuggaccaucgugaagcccggcgacauccuggugaucaacucgaacgggaaccugaucgcgccccggggcuacuucaagaugcgcaccgggaaguccagcaucaugcgguccgacgccccgaucggcacgugcucguccgagugcaucacccccaacgggagcauccccaacgacaagcccuuccagaacgucaacaagaucaccuacggcgccugcccgaaguacgugaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcucgauccgcaacgggaccuacgaccacgacguguaccgggacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagaagggcaacauccgcugcaacaucugcaucuga

SEQ ID NO: 652 - RNA, 1701 nt, Artificial Sequence
  derived and/or modified CDS sequence (AUadapt) from InfluenzaA__ABB04939__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacucgccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagucggggggcuccuacacgugcaagcgcgggagcgugaacuccuucuucagccggcugaacuggcucuacgaguccgagagcaaguaccccguccugaacgugaccaugcccaacaacggcaaguucgacaagcuguacaucuggggcgugcaccaccccuccaccgacaaggagcagaccaaccucuacguccgcgccucggggcgggugaccgugagcacgaagcgcucccagcagaccgucaucccgaacaucggcagccggcccugggugcgcgggcuguccagccggaucuccaucuacuggaccaucgugaagcccggcgacauccugcucaucaacucgaucggcaaccugaucgcgccccgcggguacuucaagauccggaccggcaaguccagcaucaugcgcuccgacgccccgaucgggaucugcagcuccgagugcaucacgcccaacggcagcauccccaacgacaagcccuuccagaacgucaacaagaucaccuacggggccugcccgcgguacgugaagcagaacacccugaagcucgccaccggcaugcgcaacgugcccgagaagcagacgcggggcaucuucggggccaucgccggcuucaucgagaacgggugggagggcauggucgacgggugguacggcuuccgccaccagaacuccgagggcaccgggcaggcggccgaccugaaguccacccaggccgccguggaccagaucaacggcaagcugaaccggcucaucgagaagaccaacgagaaguuccaccagaucgagaaggaguucuccgagguggaggggcgcauccaggaccuggagaaguacgucgaggacacgaagaucgaccuguggucguacaacgccgagcuccugguggcgcuggagaaccagcacaccaucgaccucaccgacuccgagaugaacaagcuguucgagaagacccggaagcagcugcgcgagaacgccgaggacaugggcaacgggugcuucaagaucuaccacaagugcgacaacgccugcaucggcagcauccgcaacggcacguacgaccacgacgucuaccgggacgaggcccucaacaaccgcuuccagaucaaggggguggagcugaaguccggcuacaaggacuggauccuguggaucagcuucgccaucagcugcuuccuccugugcgugguccugcucggguucaucaugugggcgugccagaagggcaacauccggugcaacaucugcaucuga

SEQ ID NO: 653 - RNA, 1701 nt, Artificial Sequence
  derived and/or modified CDS sequence (AUadapt) from InfluenzaA__ABB04950__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgucgcugcggucccucgucgccagcuccggcacgcuggaguucaucaacgagggguucaacuggaccggcgugacccagagcgggggcuccuacacgugcaagcgcgggucggugaacuccuucuucagccggcugaacuggcucuacgaguccgagagcaaguaccccguccugaacgugaccaugcccaacaacggcaaguucgacaagcuguacaucuggggcgugcaccaccccuccaccgacaaggagcagaccaaccucuacguccgcgccucggggaaggugaccgugagcacgaagcggucccagcagaccgucaucccgaacaucggcagccgccccugggugcgggggcuguccucgcgcaucuccaucuacuggaccaucgugaagcccggcgacauccugcucaucaacagcaccggcaaccugaucgcgccccggggguacuucaagauccgcacgggcaaguccagcaucaugcgguccgacgccccgaucgggaccugcucguccgagugcaucacccccaacggcagcauccccaacgacaagcccuuccagaacgucaacaagaucaccuacggggccugcccgcgcuacgugaagcagaacacgcugaagcucgccaccggcaugcggaacgugcccgagaagcagacccgcggcaucuucggggccaucgccggcuucaucgagaacgggugggagggcauggucgacgggugguacggcuuccggcaccagaacuccgagggcaccgggcaggcggccgaccugaaguccacgcaggccgccaucgaccagaucaacggcaagcugaaccgccucaucgagaagaccaacgagaaguuccaccagaucgagaaggaguucuccgagguggaggggcggauccaggaccuggagaaguacguggaggacaccaagaucgaccuguggagcuacaacgccgagcuccuggucgcgcuggagaaccagcacaccaucgaccucacggacuccgagaugaacaagcuguucgagaagacccgcaagcagcugcgggagaacgccgaggacaugggcaacgggugcuucaagaucuaccacaagugcgacaacgccugcaucggcucgauccgcaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcguggugcugcucggguucaucaugugggcgugccagaagggcaacauccgcugcaacaucugcaucuga

SEQ ID NO: 654 - RNA, 1701 nt, Artificial Sequence
  derived and/or modified CDS sequence (AUadapt) from InfluenzaA__ABB04983__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgaccgcaucugcgacucgccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccggcguggcccagaacgggaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucgggccgcgugaccgucagcaccaagcggucccagcagaccgugaucccgaacaucgggucgcgccccugggugcggggcgucuccagccgcaucuccaucuacuggacgaucgugaagcccggcgacauccuccugaucaacucgaccgggaaccugaucgcgccccggggcuacuucaagauccgcuccgggaaguccuccaucaugcggagcgacgccccgaucggcaagugcaacuccgagugcaucacccccaacggcucgauccccaacgacaagcccuuccagaacgugaaccgcaucaccuacgggccgugcccccgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggccgcgaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggguacaaggacuggauccucuggaucucguucgccaucagcugcuuccugcugugcaucgugcuccugggcuucaucaugugggccugccagaagggcaacauccggugcaacaucugcaucuga

SEQ ID NO: 655 - RNA, 1701 nt, Artificial Sequence; identical to SEQ ID NO: 417
  derived and/or modified CDS sequence (AUadapt) from InfluenzaA__ABB04994__HA

SEQ ID NO: 656 - RNA, 1701 nt, Artificial Sequence
  derived and/or modified CDS sequence (AUadapt) from InfluenzaA__ABB05005__HA
augaagaccaucaucgcccugucgcacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccggacaucggcucccgccccugggugcgcggggucucgucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccgugcccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 657 - RNA, 1701 nt, Artificial Sequence
  derived and/or modified CDS sequence (AUadapt) from InfluenzaA__ABB05183__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgagcacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaaggucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 658 - RNA, 1701 nt, Artificial Sequence
  derived and/or modified CDS sequence (AUadapt) from InfluenzaA__ABB05194__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaucaugcccaacaacgagaaguucgacaagcuguacaucuggggcguccaccaccccucgaccgacuccgaccagaucagccuguacgcccaggccagcgggcgcgugacgguguccaccaagcggucgcagcagaccgucaucccgaacaucgggucccgccccugggugcggggcgugagcucccgcaucucgaucuacuggaccaucgucaagcccggcgacauccuccugaucaacuccacggggaaccugaucgcgccccggggcuacuucaagauccgcagcgggaaguccucggugaugcgguccgacgccagcaucggcaagugcaacuccgagugcaucaccccgaacggcucgauccccaacgacaagcccuuccagaacgugaaccgcaucaccuacggggccugcccccgguacgucaagcagaacacccucaagcuggccacgggcaugcgcaacgugccggagaagcagacccgggggaucuucggcgccaucgccggguucaucgagaacggcugggagggcaugguggacgggugguacggcuuccgccaccagaacuccgaggggaccggccaggccgcggaccugaaguccacccaggccgccaucaaccagaucaacgggaagcucaaccggcugaucgagaagacgaacgagaaguuccaccagaucgagaaggaguucuccgaggucgagggccgcauccagaaccuggagaaguacguggaggacaccaagaucgaccucuggagcuacaacgccgagcugcugguggcccucgagaaccagcacaccaucgaccugaccgacuccgagaugaacaagcuguucgagcggacgaagaagcagcuccgcgagaacgcggaggacaugggcaacgggugcuucaagaucuaccacaagugcgacaacgccugcaucggcucgauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcugugcgucgugcuccugggcuucaucaugugggccugccagaagggcaacauccggugcaacaucugcaucuga

SEQ ID NO: 659 - RNA, 1701 nt, Artificial Sequence
  derived and/or modified CDS sequence (AUadapt) from InfluenzaA__ABB05205__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaacgccuacuccaacugcuaccccuacgacgugccggacuacgcgucgcuccgcucccuggucgccagcuccggcacgcuggaguucaacucggaguccuucaacuggaccgggguggcccagaacggcaccagcuccgccugcaagcggcgcucgaacaaguccuucuucagccggcucaacuggcugcaccagcugaaguacaaguaccccgcgcucaacgugaccaugcccaacaacgagaaguucgacaagcuguacaucuggggcguccaccaccccgggacggacuccgaccagaucucgcuguacgcccaggccagcgggcgcgugaccguguccaccaagcggucgcagcagaccgucaucccgaacaucggcucccgccccugggugcggggcgugagcucccgcaucucgaucuacuggacgaucgucaagcccggggacauccuccugaucaacuccaccggcaaccugaucgcgccccggggguacuucaagauccgcagcggcaaguccucgaucaugcgguccgacgccccgaucggcaagugcaacagcgagugcaucacccccaacggguccauccccaacaacaagcccuuccagaacgugaaccgcaucaccuacggcgccugcccgcgguacgugaagcagaacacgcucaagcuggccaccgggaugcgcaacguccccgagaagcagacccggggcaucuucggggccaucgccggcuucaucgagaacggcugggaggggaugguggacggcugguacggguuccgccaccagaacucggagggcaccgggcaggccgcggaccugaaguccacgcaggccgccaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 660 - RNA, 1701 nt, Artificial Sequence; identical to SEQ ID NO: 317
  derived and/or modified CDS sequence (AUadapt) from InfluenzaA__ABB05216__HA

SEQ ID NO: 661 - RNA, 1701 nt, Artificial Sequence
  derived and/or modified CDS sequence (AUadapt) from InfluenzaA__ABB46392__HA
augaagaccaucaucgcccugucguacaucuucugccucgccuucgcgcaggaccugcccggcaacgacaacuccaccgccacgcugugccucgggcaccacgccgugccgaacggcacccuggucaagaccaucaccaacgaccagaucgaggugacgaacgccaccgagcuggugcagucguccagcaccgggaagaucugcgacaacccccaccgcauccucgacggcaucaacugcacccugaucgacgcccugcucggggacccccacugcgacggcuuccagaacgagaagugggaccuguucgucgagcgguccaaggcguucucgaacugcuaccccuacgacgugccggacuacgccucccugcgcucgcucguggccuccagcggcacgcuggaguucaucaacgagggguucaacuggaccggcgucacccagaacgggggcuccucggccugcaagcgggggcccgacaacggcuucuucucccgccugaacuggcucuacaagucgggcuccaccuaccccgugcagaacgugacgaugcccaacaacgacaacagcgacaagcuguacaucuggggcguccaccacccgaacaccgacaaggagcagaccgaccuguacgugcaggcguccgggaaggugaccgucucgacgaagcggucccagcagaccaucauccccaacguggggucgcgccccugggugcggggccucagcucccgcgucucgaucuacuggaccaucgugaagcccggcgacauccuggugaucaacuccaacgggaaccugaucgccccgcggggcuacuucaagaugcgcaccggcaagucguccaucaugcggagcgacgcccccaucgggacgugcuccucggagugcaucacccccaacggguccauccccaacgacaagccguuccagaacgucaacaagaucaccuacggcgccugccccaaguacgugaagcagaacacccucaagcuggccacgggcaugcgcaacgugcccgagaagcagacccgggggaucuucggcgcgaucgccggguucaucgagaacggcugggaggggaugaucgacggcugguacggcuuccgccaccagaacucggaggggaccggccaggccgccgaccugaaguccacccagacggccaucgaccagaucaacgggaagcucaaccgggucaucgagaagaccaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucacggacucggagaugaacaagcuguucgagaagacccggcgccagcugcgggagaacgccgaggacauggggaacggcugcuucaagaucuaccacaagugcgacaacgccugcaucggcuccauccgcaacgggaccuacgaccacgacguguaccgggacgaggcccucaacaaccgcuuccagaucaagggcgucgagcucaagucgggguacaaggacuggauccuguggaucuccuucgcgaucagcugcuuccugcugugcguggugcugcucggcuucaucaugugggccugccagaagggcaacauccgcugcaacaucugcaucuga

SEQ ID NO: 662 - RNA, 1701 nt, Artificial Sequence
  derived and/or modified CDS sequence (AUadapt) from InfluenzaA__ABB46414__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcgagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccucggccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucagcaucuacuggaccaucgucaagcccggcgacauccuccugaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucucggagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccuguucugcgugguccugcucggcuucaucaugugggccugccagaagggcaacauccggugcaacaucugcaucuga

SEQ ID NO: 663 - RNA, 1701 nt, Artificial Sequence
  derived and/or modified CDS sequence (AUadapt) from InfluenzaA__ABB46425__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccucguccaccgggaagaucugcgacagcccccaccgcauccuggacggcgagaacugcacccugaucgacgcccuccugggggacccccacugcgacggcuuccagaacaaggagugggaccuguucguggagcgguccaaggccuacucgaacugcuaccccuacgacgugccggacuacgcgucccuccgcagccuggucgccuccucgggcacgcuggaguucaacaacgaguccuucaacuggaccgggguggcccagaacggcaccagcuucgccugcaagcggcgcuccaucaagagcuucuucucccggcucaacuggcugcaccagcugaaguacaaguaccccgcgcucaacgugaccaugcccaacaacgacaaguucgacaagcuguacaucuggggcguccaccaccccucgacggacuccgaccagaccagccuguacgcccaggccucggggcgcgugaccguguccaccaagcggagccagcagacggucaucccgaacaucgggucccgccccugggugcggggcgugucgucccgcaucagcaucuacuggaccaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacucggaggggacgggccaggccgcggaccugaaguccacccaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacacgaucgaccugaccgacucggagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcucaagagcggguacaaggacuggauccuguggaucagcuucgccaucuccugcuuccugcugugcgugguccuccugggcuucaucaugugggccugccagaagggcaacauccgcugcaacaucugcaucuga

SEQ ID NO: 664 - RNA, 1701 nt, Artificial Sequence
  derived and/or modified CDS sequence (AUadapt) from InfluenzaA__ABB46436__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguacgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 665 - RNA, 1701 nt, Artificial Sequence; identical to SEQ ID NO: 598
  derived and/or modified CDS sequence (AUadapt) from InfluenzaA__ABB46447__HA

SEQ ID NO: 666 - RNA, 1701 nt, Artificial Sequence
  derived and/or modified CDS sequence (AUadapt) from InfluenzaA__ABB46458__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcaaccagcagaccgugaucccgaacaucggcucgcggccccgcguccgggacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaagucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucauguggggcugccagaaggggaacauccggugcaacaucugcaucuga

SEQ ID NO: 667 - RNA, 1701 nt, Artificial Sequence
  derived and/or modified CDS sequence (AUadapt) from InfluenzaA__ABB51961__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguucuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgugcguccggucccugguggccagcuccgggacgcucgaguucaacaacgagucguucaacugggccggcgugacccagaacgggaccuccagcgccugcaagcgccgguccaacaagucguucuucucccgccugaacuggcugacccaccucaaguacaaguaccccgcgcugaacgucacgaugcccaacaacgagaaguucgacaagcuguacaucuggggcgugcaccaccccgggaccgacagcgaccagaucucccucuacgcccaggccucgggccggaucaccguguccacccagcgcugcaagcagcuggucaucccgaacaucggcagccggccccgcgugcgggacgugucgucccgcaucagcaucuacuggacgaucgucaaccccggggacauccugcucaucaacuccaccggcaaccugaucgcgccccggggguacuucaagauccgcucgggcaaguccagcaucaugcgguccgacgccccgaucggcaagugcaacucggagugcaucacccccaacggguccauccccaacgacaagcccuuccagaacgugaaccgcaucaccuacggcgccugcccgcgguacgugaagcagaacacgcugaagcucgccaccgggaugcgcaacguccccgagaagcagacccggggcaucuucggggccaucgccggcuucaucgagaacggcugggaggggaugguggacggcugguacggguuccgccaccagaacagcgagggcaccgggcaggccgcggaccugaaguccacgcaggccgccaucaaccagaucaacggcaagcugaaccggcucaucggcaagaccaacgagaaguuccaccagaucgagaaggaguucucggagguggaggggcgcauccaggaccuggagaaguacgucgaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacaugggcaacgggugcuucaagaucuaccacaagugcgacaacgccugcaucgaguccauccgcaacggcaccuacgaccacgacguguaccgggacgaggcccucaacaaccgcuuccagaucaagggggucgagcucaagucgggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 668 - RNA, 1698 nt, Artificial Sequence
  derived and/or modified CDS sequence (AUadapt) from InfluenzaA__ABB51962__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugucggucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgccaugucccggggcuucggcagcgggaucuccacgagcaacgcccccaugggcgagugcgacgcgaaguuccagacgccccagggcgggaucaacaucucccuccccuuccagaacguccacccggugaccaucggggagugccccaacuacgugcgcucggccaagcugcggauggucaccggccugcgcaacauccccuccauccagagccggggccucuucggggccaucgccggcuucaucgagggcggguggaccgggaugguggacggcugguacggcuaccaccaccagaacgagcagggguccggcuacgccgcggaccagaaguccacccagaacgccaucaacgggaucaccaacaaggugaacagcgucaucgagaagaugaacacccaguucacggccgugggcaaggaguucaacaagcuggagcgccggauggagaaccugaacaagaaggucgacgacggguuccucgacaucuggaccuacaacgccgagcugcuggugcuccuggagaacgagcgcacccuggacuuccacgacagcaacgugaagaaccucuacgagaaggucaagucccagcugaagaacaacgccaaggagaucggcaacggcugcagcgaguucuaccacaagugcaacaacgagugcauggaguccgugaagaacgggaccuacgacuaccccaaguacucggaggaguccaagcugaaccgggagaagaucgacggcgugaagcucgagagcaugggggucuaccagauccuggcgaucuacagcacgguggccuccagccuggugcuccuggucucccugggcgccaucagcuucuggaugugcuccaacggcagccuccagugccgcaucugcaucuga

SEQ ID NO: 669 - RNA, 1701 nt, Artificial Sequence
  derived and/or modified CDS sequence (AUadapt) from InfluenzaA__ABB51963__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcggucgaaggccuacuccaacugcuaccccuacgacgugccggacuacgcgagccugcgcucccucgucgccucguccgggacgcuggaguucaacaacgagagcuucaacuggaccggcgugacccagaacgggaccuccucggccugcaagcggcgcuccaacaacucguucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugucgacgaagcggucgcagcagaccgugaucccgaacaucggcucccgcccccggguccgccacauccccagccggaucuccaucuacuggaccaucgugaaccccggggacauccugcucaucaacucgaccggcaaccugaucgccccgcgcggguacuucaagauccgguccggcaagagcuccaucaugcgcucggacgcccccaucggcaagugcaacuccgagugcaucacgcccaacgggucgauccccaacgacaagccguuccagaacgugaaccggaucaccuacggcgccugcccccgcuacgucaagcagaacacccugaagcucgcgaccgggaugcggaacgugcccgagaagcagaaccgcggcaucuucggggccaucgccggcuucaucgagaacggcugggaggggaugguggacggcugguacggguuccggcaccagaacuccgagggcaucgggcaggccgccgaccugaaguccacgcaggcggccaucaaccagaucaacgagaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagcgcaccaagaagcagcugcgcgagaacgccgaggacauggggaacggcugcuucaaggucuaccacaagugcgacaacgcgugcaucgggucgauccggaacggcaccuacgaccacaacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 670 - RNA, 1701 nt, Artificial Sequence; identical to SEQ ID NO: 527
  derived and/or modified CDS sequence (AUadapt) from InfluenzaA__ABB51964__HA

SEQ ID NO: 671 - RNA, 1698 nt, Artificial Sequence
  derived and/or modified CDS sequence (AUadapt) from InfluenzaA__ABB53603__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccucguggcccaaccacacggugaccggggucuccgccagcugcucccacaacggcaagagcuccuucuaccgcaaccugcuguggcucaccgggaagaacggccuguaccccaaccugagcaaguccuacgccaacaacaagaagaaggaggugcucauccuguggggcgugcaccacccgcccaacaucgggaaccagcggacccuguacuacacggagaacgccuacgucagcguggugagcucccacuacucgcgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 672 - RNA, 1701 nt, Artificial Sequence; identical to SEQ ID NO: 500
  derived and/or modified CDS sequence (AUadapt) from InfluenzaA__ABB53614__HA

SEQ ID NO: 673 - RNA, 1701 nt, Artificial Sequence; identical to SEQ ID NO: 500
  derived and/or modified CDS sequence (AUadapt) from InfluenzaA__ABB53625__HA

SEQ ID NO: 674 - RNA, 1701 nt, Artificial Sequence; identical to SEQ ID NO: 527
  derived and/or modified CDS sequence (AUadapt) from InfluenzaA__ABB53652__HA

SEQ ID NO: 675 - RNA, 1701 nt, Artificial Sequence
  derived and/or modified CDS sequence (AUadapt) from InfluenzaA__ABB53663__HA
augaagaccaucuucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggcccacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaacuucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 676 - RNA, 1701 nt, Artificial Sequence; identical to SEQ ID NO: 500
  derived and/or modified CDS sequence (AUadapt) from InfluenzaA__ABB53685__HA

SEQ ID NO: 677 - RNA, 1701 nt, Artificial Sequence
  derived and/or modified CDS sequence (AUadapt) from InfluenzaA__ABB53696__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcaucgcccuccugggcuucaucaugugggcgugccagaagggcaacauccggugcaacgugugcaucuga

SEQ ID NO: 678 - RNA, 1698 nt, Artificial Sequence; identical to SEQ ID NO: 541
  derived and/or modified CDS sequence (AUadapt) from InfluenzaA__ABB53707__HA

SEQ ID NO: 679 - RNA, 1701 nt, Artificial Sequence; identical to SEQ ID NO: 488
  derived and/or modified CDS sequence (AUadapt) from InfluenzaA__ABB53718__HA

SEQ ID NO: 680 - RNA, 1698 nt, Artificial Sequence
  derived and/or modified CDS sequence (AUadapt) from InfluenzaA__ABB53740__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaugggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggagaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 681 - RNA, 1701 nt, Artificial Sequence
  derived and/or modified CDS sequence (AUadapt) from InfluenzaA__ABB53751__HA
augaagaccaucaucgcccugucguacaucuccugccucguguucgcccagaaccugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucucgaacugcuaccccuacgacgugccggacuacgcgucccugcggagccucgucgccuccucgggcacgcuggaguucaucaacgagggguucaacuggaccggcgugacccaguccgggggcagcuacgccugcaagcgcggguccgacaacagcuucuucucccggcugaacuggcucuacaagucggaguccaaguaccccgugcugaacgucaccaugcccaacaacggcaacuucgacaagcuguacaucuggggcgugcaccaccccagcacggacaaggagcagaccaaccucuacgugcgcgccucggggcgggucaccguguccaccaagcgcagccagcagacgaucaucccgaacaucggcucccggcccugggugcgcgggcugucguccggcaucagcaucuacuggaccaucgucaagcccggcgacauccugcucaucaacuccaacgggaaccugaucgcgccccggggcuacuucaagauccgcaccggcaagagcuccauccugcggucggacgccccgaucgggaccugcuccagcgagugcaucacgcccaacggguccauccccaacgacaagcccuuccagaacgugaacaagaucaccuacggcgccugcccgaaguacgugaagcagaacacccucaagcuggccaccggcaugcgcaacguccccgagaagcagacgcgggggaucuucggcgccaucgcgggguucaucgagaacggcugggaggggaugguggacggcugguacggcuuccgccaccagaacucggaggggaccggccaggccgccgaccugaaguccacccaggccgccaucgaccagaucaacgggaagcucaaccgggugaucgagaagaccaacgagaaguuccaccagaucgagaaggaguucagcgaggucgagggccgcauccaggaccuggagaaguacguggaggacacgaagaucgaccugugguccuacaacgcggagcuccugguggcccuggagaaccagcacaccaucgaccucaccgacucggagaugaacaagcuguucgagaagacccggcgccagcugcgggagaacgccgaggacauggggaacggcugcuucaagaucuaccacaagugcgacaacgccugcaucggcuccauccgcaacgggacguacgaccacgacgucuaccgcgacgaggcccucaacaaccgguuccagaucaagggcguggagcucaagagcggguacaaggacuggauccuguggaucagcuucgcgaucuccugcuuccugcugugcgucgugcugcucggcuucaucaugugggccugccagaagggcaacauccgcugcaacaucugcaucuga

SEQ ID NO: 682 - RNA, 1701 nt, Artificial Sequence
  derived and/or modified CDS sequence (AUadapt) from InfluenzaA__ABB60007__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgaccgcaucugcgacucgccccaccggauccuggacggggagaacugcacccugaucgacgcccuccugggcgacccccacugcgacggguuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccggcguggcccagaacgggaccuccuacgccugcaagcgccggagcaucaaguccuucuucucgcgccucaacuggcugcaccagcugaaguacaaguaccccgcgcucaacgugaccaugcccaacaacgacaaguucgacaagcuguacaucuggggcguccaccaccccuccacggacagcgaccagaccucccuguacgcccaggccucggggcgggugaccgugagcaccaagcgcucccagcagacggucaucccgaacaucggcucgcggcccugggugcgcgggguguccagccggaucuccaucuacuggaccaucgucaagcccggcgacauccuccugaucaacucgaccggcaaccugaucgcgccccgcggguacuucaagauccgguccggcaagagcuccaucaugcgcucggacgccccgaucgggaagugcaacuccgagugcaucacccccaacggcagcauccccaacgacaagcccuuccagaacgugaaccggaucacguacggcgccugcccgcgcuacgugaagcagaacacccucaagcuggccaccgggaugcggaacguccccgagaagcagacccgcggcaucuucggggccaucgccggcuucaucgagaacgggugggagggcaugguggacggcugguacggguuccggcaccagaacuccgagggcacggggcaggccgcggaccugaaguccacccaggccgccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacacgaucgaccugaccgacuccgagaugaacaagcuguucgagcgcacccgcaagcagcuccgggagaacgcggaggacaugggcaacggcugcuucaagaucuaccacaagugcgacaacgccugcaucgggagcauccgcaacggcaccuacgaccacgacguguaccgggacgaggcccugaacaaccgcuuccagaucaagggggucgagcugaaguccggcuacaaggacuggauccucuggaucucguucgccaucagcugcuuccugcugugcgugguccuccugggguucaucaugugggccugccagaagggcaacauccggugcaacaucugcaucuga

SEQ ID NO: 683 - RNA, 1701 nt, Artificial Sequence
  derived and/or modified CDS sequence (AUadapt) from InfluenzaA__ABB77853__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccagaacggcaccucguacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucagcaucuacuggaccaucgucaagcccggcgacauccugcucaucaacuccaccgggaaccugaucgcgccccgcggcuacuucaagauccggucggggaaguccagcaucaugcgcuccgacgccccgaucggcaagugcaacucggagugcaucacccccgacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggguacaaggacuggauccuguggaucagcuucgccaucuccugcuuccugcugugcgugguccugcucggcuucaucaugugggccugccagaagggcaacauccggugcaacaucugcaucuga

SEQ ID NO: 684 - RNA, 1701 nt, Artificial Sequence
  derived and/or modified CDS sequence (AUadapt) from InfluenzaA__ABB79731__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggucgcucgucgccuccucggggacgcuggaguucaacaacgaguccuucaacuggaccggcgugacccagaacgggaccagcuccgccugcaagcgccggucgaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaccucccuguacgcgcaggccucgggccggaucacgguguccaccaagcgcagccagcagaccgugaucccgaacaucggcucgcggccccgcguccgggacauccccucccgcaucucgaucuacuggaccaucgugaagcccggggacauccugcucaucaacuccacgggcaaccugaucgccccgcggggguacuucaagauccgcagcggcaaguccucgaucaugcgguccgacgcccccaucggcaagugcaacucggagugcaucacccccaacggguccauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcucaagucgggcuacaaggacuggauccuguggaucuccuucgccaucagcugcuuccugcugugcguggcccugcucggguucaucaugugggccugccagaagggcaacauccggugcaacaucugcaucuga

SEQ ID NO: 685 - RNA, 1701 nt, Artificial Sequence
  derived and/or modified CDS sequence (AUadapt) from InfluenzaA__ABB79788__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacucgccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccucguccggcacgcuggaguucaucaacgagggguucaacuggaccggcgugacccagagcgggggcuccuacgccugcaagcgcgggagcgugaacuccuucuucucgcggcugaacuggcucuacgaguccgagagcaaguaccccguccugaacgugaccaugcccaacaacggcaaguucgacaagcuguacaucuggggcgugcaccaccccaucacggacaaggagcagaccaaccucuacguccgcgccuccgggcgggugaccgugagcaccaagcgcucgcagcagacggucaucccgaacaucggcucccggcccugggugcgcgggcugagcucccggaucagcaucuacuggaccaucgugaagcccggcgacauccugcucaucaacuccaccggcaaccugaucgcgccccgcggguacuucaagauccggaccggcaagucguccaucaugcgcagcgacgccccgaucgggacgugcuccagcgagugcaucacccccaacggcuccauccccaacgacaagcccuuccagaacgucaacaagaucaccuacggggccugcccgcgguacgugaagcagaacacccugaagcucgccacgggcaugcgcaacgugcccgagaagcagacccggggcaucuucggggccaucgcgggcuucaucgagaacgggugggagggcauggucgacgggugguacggcuuccgccaccagaacucggagggcaccgggcaggccgccgaccugaaguccacccaggccgccaucgaccagaucaacggcaagcugaaccggcucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggaagcagcugcgcgagaacgccgaggacaugggcaacgggugcuucaagaucuaccacaagugcgacaacgccugcaucggcuccauccgcaacggcaccuacgaccacgacguguaccgggacgaggcccucaacaaccgcuuccagaucaagggggucgagcugaaguccggcuacaaggacuggauccuguggaucuccuucgcgaucagcugcuuccuccugugcguggugcugcucggguucaucaugugggccugccagaagggcaacauccggugcaacaucugcaucuga

SEQ ID NO: 686 - RNA, 1701 nt, Artificial Sequence
  derived and/or modified CDS sequence (AUadapt) from InfluenzaA__ABB79799__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgucgcugcggucccucgucgccagcuccggcacgcuggaguucaucaacgagggguucaacuggaccggcgugacccagagcgggggcuccuacgccugcaagcgcgggucggugaacuccuucuucagccggcugaacuggcucuacgaguccgagagcaaguaccccguccugaacgugaccaugcccaacaacggcaaguucgacaagcuguacaucuggggcgugcaccaccccuccacggacaaggagcagaccaaccucuacguccgcgccucggggaaggugaccgugagcaccaagcggucccagcagacggucaucccgaacaucggcagccgccccugggugcgggggcuguccucgcgcaucuccaucuacuggaccaucgugaagcccggcgacauccugcucaucaacagcaccggcaaccugaucgcgccccggggguacuucaagauccgcaccggcaaguccagcaucaugcgguccgacgccccgaucgggacgugcucguccgagugcaucacccccaacggcagcauccccaacgacaagcccuuccagaacgucaacaagaucaccuacggggccugcccgcgcuacgugaagcagaacacccugaagcucgccacgggcaugcggaacgugcccgagaagcagacccgcggcaucuucggggccaucgcgggcuucaucgagaacgggugggagggcauggucgacgggugguacggcuuccggcaccagaacuccgagggcaccgggcaggccgccgaccugaaguccacccaggccgccaucgaccagaucaacggcaagcugaaccgccucaucgagaagacgaacgagaaguuccaccagaucgagaaggaguucuccgagguggaggggcggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgcaagcagcugcgggagaacgccgaggacaugggcaacgggugcuucaagaucuaccacaagugcgacaacgccugcaucggcucgauccgcaacggcaccuacgaccacgacguguaccgcgacgaggcccucaacaaccgguuccagaucaagggggucgagcugaaguccggcuacaaggacuggauccuguggaucagcuucgcgaucagcugcuuccuccugugcguggugcugcucggguucaucaugugggccugccagaagggcaacauccgcugcaacaucugcaucuga

SEQ ID NO: 687 - RNA, 1701 nt, Artificial Sequence
  derived and/or modified CDS sequence (AUadapt) from InfluenzaA__ABB79810__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgccugugcgacagcccccaccggauccuggacggcaagaacugcacccucaucgacgcccugcugggggacccccacugcgacggcuuccagaacaaggagugggaccucuucguggagcgcucgaaggccuacuccaacugcuaccccuacgacgugccggacuacgcgagccugcggucccuggucgccucguccggcacgcucgaguucaucaacgaggacuucaacuggaccgggguggcccaggacggcgggagcuacgccugccgccggggcuccgugaacucguucuucucccgccugaacuggcugcacaagcucgaguacaaguaccccgcgcugaacgucaccaugcccaacaacgggaaguucgacaagcuguacaucuggggcgugcaccaccccagcaccgacuccgaccagacgucgcucuacgugcgggccuccggccgcgucaccgugagcaccaagcggucgcagcagaccgugaucccgaacaucgggucccgccccuggguccggggccagagcucccgcaucucgaucuacuggacgaucgugaagcccggggacauccugcugaucgacuccaccggcaaccucaucgcgccccggggcuacuucaagauccgcaacgggaaguccuccaucaugcggagcgacgccccgaucggcaacugcuccucggagugcaucacccccaacggguccauccccaacgacaagcccuuccagaacgugaaccgcaucaccuacggcgccugcccgcgguacgucaagcagcacacgcugaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccucaaguccacgcaggcggccaucgaccagaucaacgggaagcugaaccggcugaucgagaagaccaacgagaaguuccaccagaucgagaaggaguucucggaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagcgcacccggaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 688 - RNA, 1701 nt, Artificial Sequence
  derived and/or modified CDS sequence (AUadapt) from InfluenzaA__ABB79957__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgccugugcgacucgccccaccggauccuggacggcaagaacugcacccucaucgacgcccugcugggggacccccacugcgacggcuuccagaacaaggagugggaccucuucguggagcgcuccaaggccuacuccaacugcuaccccuacgacgugccggacuacgcgagccugcggucccuggucgccucguccggcacgcucgaguucaucaacgaggacuucaacuggaccgggguggcccaggacggcgggagcuacgccugccgccggggcuccgugaacucguucuucucccgccugaacuggcugcacaagcucgaguacaaguaccccgcgcugaacgucaccaugcccaacaacgggaaguucgacaagcuguacaucuggggcgugcaccaccccagcaccgacuccgaccagacgucgcucuacgugcgggccuccggccgcgucaccgugagcaccaagcggucgcagcagaccgugaucccgaacaucgggucccgccccuggguccggggccagagcucccgcaucgggaucuacuggacgaucgugaagcccggcgacauccugcugaucaacucgaccggcaaccucaucgcgccccggggguacuucaagauccgcaacggcaaguccagcaucaugcgguccgacgccccgaucgggaacugcucguccgagugcaucacccccaacggcagcauccccaacgacaagcccuuccagaacgugaaccgcaucaccuacggggccugcccgcgguacgucaagcagcacacgcugaagcuggccaccggcaugcgcaacgugcccgagaagcagacccggggcaucuucggggccaucgccggcuucaucgagaacgggugggagggcaugguggacgggugguacggcuuccgccaccagaacuccgagggcaccgggcaggccgccgaccucaagucgacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagcgcacccggaagcagcuccgcgagaacgccgaggacaugggcaacgggugcuucaagaucuaccacaagugcgacaacgcgugcaucggcucgauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 689 - RNA, 1701 nt, Artificial Sequence
  derived and/or modified CDS sequence (AUadapt) from InfluenzaA__ABB79968__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgccugugcgacagcccccaccggauccuggacggcaagaacugcacccucaucgacgcccugcugggggacccccacugcgacggcuuccagaacaaggagugggaccucuucguggagcgcucgaaggccuacuccaacugcuaccccuacgacgugccggacuacgcgagccugcggucccuggucgccucguccggcacgcucgaguucaucaacgaggacuucaacuggaccgggguggcccaggacggcgggagcuacgccugccgccggggcuccgugaacucguucuucucccgccugaacuggcugcacaagcucgaguacaaguaccccgcgcugaacgucaccaugcccaacaacgggaaguucgacaagcuguacaucuggggcgugcaccaccccagcaccgacuccgaccagacgucgcucuacgugcgggccuccggccgcgucaccgugagcaccaagcggucgcagcagaccgugaucccgaacaucgggucccgccccuggguccggggccagagcucccgcaucucgaucuacuggacgaucgugaagcccggggacauccugcugaucaacuccaccggcaaccucaucgcgccccggggcuacuucaagauccgcaacgggaaguccuccaucaugcggagcgacgccccgaucggcaacugcuccucggagugcaucacccccaacggguccauccccaacgacaagcccuuccagaacgugaaccgcaucaccuacggcgccugcccgcgguacgucaagcagcacacgcugaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccucaaguccacgcaggcggccaucgaccagaucaacgggaagcugaaccggcugaucgagaagaccaacgagaaguuccaccagaucgagaaggaguucucggaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagcgcacccggaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 690 - RNA, 1698 nt, Artificial Sequence
  derived and/or modified CDS sequence (AUadapt) from InfluenzaA__ABB79979__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugucggucgugagcucccacuacagccgccgguucacccccgagaucgccaagcgccccaaggugcgggaccaggaggggcgcaucaacuaccacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcucggccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagucgaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 691 - RNA, 1698 nt, Artificial Sequence
  derived and/or modified CDS sequence (AUadapt) from InfluenzaA__ABB79990__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagaaggcccuguaccacacggagaacgccuacgugagcgucgugagcucccacuacucgcggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacucgaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 692 - RNA, 1701 nt, Artificial Sequence
  derived and/or modified CDS sequence (AUadapt) from InfluenzaA__ABB80001__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacccuggaguucaacaacgagucguucaacuggaccggcgugacccagaacgggacguccagcgccugcaagcgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucacggugucgaccaagcgcucgcagcagaccgugaucccgaacaucggcucccggccccgcguccgggacauccccagccgcaucuccaucuacuggaccaucgugaagcccggggacauccugcucaucaacucgacgggcaaccugaucgccccgcggggguacuucaagauccgcuccggcaagucguccaucaugcggagcgacgcccccaucggcaagugcaacuccgagugcaucacccccaacgggucgauccccaacgacaagccguuccagaacgugaaccgcaucaccuacggcgccugcccccgguacgucaagcaguccacccugaagcucgcgacggggaugcgcaacgugcccgagaagcagacccggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 693 - RNA, 1701 nt, Artificial Sequence; identical to SEQ ID NO: 488
  derived and/or modified CDS sequence (AUadapt) from InfluenzaA__ABB80012__HA

SEQ ID NO: 694 - RNA, 1701 nt, Artificial Sequence
  derived and/or modified CDS sequence (AUadapt) from InfluenzaA__ABB80023__HA
augaagaccaucaucgcccugucguacaucuucuaccucgcccugggccaggaccugcccgggaacgacaacuccaaggcgacccucugccugggccaccacgccgugccgaacgggacgcuggucaagaccaucaccaacgaccagaccgaggugacgaacgccaccgagcucgugcagucguccagcaccggcaagaucugcaacaacccccaccgcauccuggacgggauggacugcacccugaucgacgcccuccugggcgacccccacugcgacgucuuccagaacgagacgugggaccuguucguggagcgguccaaggccuucucgaacugcuaccccuacgacgugccggacuacgcgucccuccgcucgcuggucgccuccagcggcacccuggaguucaucaccgagggguucaccuggacggaggugacccagaacggcggguccaacgccugcaagcggggccccgacucgggguucuucucccgccucaacuggcugaccaagucgggccggaccuaccccgugcugaacgucacgaugcccaacaacgacaacuucgacaagcucuacaucuggggcgugcaccacccguccaccgaccaggagcagaccaaccuguacgugcagaccagcgggcgcgucacgguguccacccggcgcucgcagcagaccaucauccccaacaucggcucccggcccugggugcgcgggcugucgagccggaucuccaucuacuggaccaucgucaagcccggcgacgugcucgugaucaacucgaacggcaaccugaucgccccgcgcggguacuucaagaugcggacgggcaaguccucgaucaugcgcuccgacgcgcccaucgacacgugcaucagcgagugcaucacccccaacggguccauccccaacgacaagccguuccagaacgucaacaagaucaccuacggcgccugccccaaguacgugaagcaggacacccugaagcucgccaccgggaugcggaacgugcccgagaagcagacccgcggccuguucggcgccaucgccggguucaucgagaacggcugggaggggaugaucgacggcugguacggguuccggcaccagaacucggagggcaccggccaggcggccgaccugaaguccacgcaggccgccaucgaccagaucaacgggaagcucaaccgcaucaucgagaagaccaacgagaaguuccaccagaucgagaaggaguucucggaggucgagggccggauccaggaccuggagaaguacguggaggacaccaagaucgaccugugguccuacaacgccgagcuccugguggcgcuggagaaccagcacaccaucgaccucacggacagcgagaugaacaagcuguucgagaagacccgccggcagcugcgcgagaacgccgaggacauggggaacggcugcuucaagaucuaccacaagugcgacaacgccugcaucgaguccauccgcaacgggaccuacgaccacgacgucuaccgggacgaggcccucaacaaccgcuuccagaucaagggcguggagcucaagucgggcuacaaggacuggauccuguggaucuccuucgccaucagcugcuuccugcugugcgucgugcugcucggguucaucaugugggcgugccagcggggcaacauccgcugcaacaucugcaucuga

SEQ ID NO: 695 - RNA, 1701 nt, Artificial Sequence
  derived and/or modified CDS sequence (AUadapt) from InfluenzaA__ABB80034__HA
augaagaccaucaucgcccugucguacaucuucugccucgugcugggccaggaccugcccgggaacgacaacuccaccgccacgcucugccugggccaccacgcggucccgaacgggacccuggugaagaccaucaccgacgaccagaucgaggugacgaacgccaccgagcucguccagagcuccucgaccggcaagaucugcaacaacccccaccgcauccuggacgggcuggacugcacccucaucgacgcccugcugggcgacccccacugcgacguguuccagaacgagacgugggaccucuucguggagcgguccaaggccuucagcaacugcuaccccuacgacgucccggacuacgccucccugcgcucgcugguggcguccagcggcacccucgaguucaucaccgagggguucaccuggacgggcgugacccagaacgggggcuccaacgccugcaagcgggggcccggcucgggcuucuucucccgccugaacuggcugaccaagagcggguccaccuaccccguccucaacgugacgaugcccaacaacgacaacuucgacaagcuguacaucuggggcgugcaccacccgucgaccaaccaggagcagaccucccuguacguccaggccagcgggcgggugaccguguccacgcgccggucgcagcagaccaucauccccaacaucggcagccgccccuggguccggggccucuccucgcgcaucuccaucuacuggaccaucgugaagcccggggacgugcuggucaucaacagcaacggcaaccugaucgccccgcggggguacuucaagaugcgcaccggcaaguccucgaucaugcgguccgacgcgacgaucgacacgugcaucagcgagugcaucacccccaacggguccauccccaacgacaagcccuuccagaacgugaacaagaucaccuacggcgccugcccgaaguacgugaagcagaacacccucaagcuggccaccggcaugcgcaacguccccgagaagcagacccgggggcuguucggcgccaucgccggguucaucgagaacggcugggaggggaugaucgacggcugguacggcuuccgccaccagaacucggaggggaccggccaggcggccgaccucaaguccacgcaggccgccaucgaccagaucaacgggaagcugaaccgggugaucgagaagaccaacgagaaguuccaccagaucgagaaggaguucagcgagguggagggccgcauccaggaccuggagaaguacgucgaggacaccaagaucgaccucugguccuacaacgccgagcugcugguggcgcucgagaaccagcacaccaucgaccugacggacucggagaugaacaagcuguucgagaagacccggcgccagcuccgggagaacgccgaggacauggggaacggcugcuucaagaucuaccacaagugcgacaacgccugcaucgaguccauccgcaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgugguccuccugggguucaucaugugggcgugccagcgcggcaacauccggugcaacaucugcaucuga

SEQ ID NO: 696 - RNA, 1698 nt, Artificial Sequence; identical to SEQ ID NO: 609
  derived and/or modified CDS sequence (AUadapt) from InfluenzaA__ABB80045__HA

SEQ ID NO: 697 - RNA, 1701 nt, Artificial Sequence
  derived and/or modified CDS sequence (AUadapt) from InfluenzaA__ABB80081__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccagaacggcaccucguacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucagcaucuacuggaccaucgucaagcccggcgacauccugcucaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggguacaaggacuggauccuguggaucagcuucgccaucuccugcuuccugcugugcgugguccugcucggcuucaucaugugggccugccagaagggcaacauccggugcaacaucugcaucuga

SEQ ID NO: 698 - RNA, 1701 nt, Artificial Sequence
  derived and/or modified CDS sequence (AUadapt) from InfluenzaA__ABB80092__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccagaacggcaccucguacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucagcaucuacuggacccuggucaagcccggcgacauccuccugaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucucggagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagucgggguacaaggacuggauccuguggaucagcuucgccaucuccugcuuccugcugugcgugguccuccugggcuucaucaugugggccugccagaagggcaacauccggugcaacaucugcaucuga

SEQ ID NO: 699 - RNA, 1701 nt, Artificial Sequence; identical to SEQ ID NO: 500
  derived and/or modified CDS sequence (AUadapt) from InfluenzaA__ABB80137__HA

SEQ ID NO: 700 - RNA, 1701 nt, Artificial Sequence; identical to SEQ ID NO: 697
  derived and/or modified CDS sequence (AUadapt) from InfluenzaA__ABB80159__HA

SEQ ID NO: 701 - RNA, 1701 nt, Artificial Sequence; identical to SEQ ID NO: 268
  derived and/or modified CDS sequence (AUadapt) from InfluenzaA__ABB80185__HA

SEQ ID NO: 702 - RNA, 1701 nt, Artificial Sequence
  derived and/or modified CDS sequence (AUadapt) from InfluenzaA__ABB80207__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcgagaacugcacccugaucgacgcccuccugggggacccccacugcgacgacuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccggcguggcccagaacgggaccuccuacgccugcaagcgccggagcaucaaguccuucuucucgcgccucaacuggcugcaccagcugaaguacaaguaccccgcgcucaacgugaccaugcccaacaacgacaaguucgacaagcuguacaucuggggcguccaccaccccuccacggacagcgaccagaccucccuguacgcccaggccucggggcgggugaccgugagcaccaagcgcucccagcagacggucaucccgaacaucggcucgcggcccugggugcgcgggguguccagccggaucuccaucuacuggaccaucgucaagcccggcgacauccuccugaucaacucgaccggcaaccugaucgcgccccgcggguacuucaagauccgguccggcaagagcuccaucaugcgcucggacgccccgaucgggaagugcaacuccgagugcaucacccccaacggcagcauccccaacgacaagcccuuccagaacgugaaccggaucacguacggcgccugcccgcgcuacgugaagcagaacacccucaagcuggccaccgggaugcggaacguccccgagaagcagacccgcggcaucuucggggccaucgccggcuucaucgagaacgggugggagggcaugguggacggcugguacggguuccggcaccagaacuccgagggcacggggcaggccgcggaccugaaguccacccaggccgccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacacgaucgaccugaccgacuccgagaugaacaagcuguucgagcgcacccgcaagcagcuccgggagaacgcggaggacaugggcaacggcugcuucaagaucuaccacaagugcgacaacgccugcaucgggagcauccgcaacggcaccuacgaccacgacguguaccgggacgaggcccugaacaaccgcuuccagaucaagggggucgagcugaaguccggcuacaaggacuggauccucuggaucucguucgccaugagcugcuuccugcugugcgugguccuccugggguucaucaugugggccugccagaagggcaacauccggugcaacaucugcaucuga

SEQ ID NO: 703 - RNA, 1701 nt, Artificial Sequence
  derived and/or modified CDS sequence (AUadapt) from InfluenzaA__ABB80229__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccgggguggcccagaacggcaccuccuacgccugcaagcgccggagcaucaaguccuucuucucgcgccucaacuggcugcaccagcugaaguacaaguaccccgcgcucaacgugaccaugcccaacaacgacaaguucgacaagcuguacaucuggggcguccaccaccccuccacggacagcgaccagaccucccuguacgcccaggccucggggcgggugaccgugagcaccaagcgcucccagcagacggucaucccgaacaucgggucgcggcccugggugcgcggcguguccagccggaucuccaucuacuggaccaucgucaagcccggcgacauccuccugaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacacgaucgaccugaccgacuccgagaugaacaagcuguucgagcgcacccgcaagcagcuccgggagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggguacaaggacuggauccucuggaucucguucgccaugagcugcuuccugcugugcgugguccuccugggcuucaucaugugggccugccagaagggcaacauccggugcaacaucugcaucuga

SEQ ID NO: 704 - RNA, 1701 nt, Artificial Sequence; identical to SEQ ID NO: 697
  derived and/or modified CDS sequence (AUadapt) from InfluenzaA__ABB80240__HA

SEQ ID NO: 705 - RNA, 1701 nt, Artificial Sequence
  derived and/or modified CDS sequence (AUadapt) from InfluenzaA__ABB80251__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccgggguggcccagaacggcaccuccucggccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucucgaucuacuggaccaucgucaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacucggaggggacgggccaggccgcggaccugaaguccacccaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacucggagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggccugaucaugugggccugccagaagggcaacauccggugcaacaucugcaucuga

SEQ ID NO: 706 - RNA, 1701 nt, Artificial Sequence
  derived and/or modified CDS sequence (AUadapt) from InfluenzaA__ABB80492__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucguccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacucgaacugcuaccccuacgacgugccggacuacgcgucccuccggagccuggucgccuccucgggcacgcuggaguucaacaacgaguccuucaacuggaccgggguggcccagaacggcaccagcuacgccugcaagcgccgguccaucaagucguucuucucccgccucaacuggcugcaccagcugaaguacaaguaccccgcgcucaacgugaccaugcccaacaacgacaaguucgacaagcuguacaucuggggcguccaccaccccagcacggacuccgaccagaccucgcuguacgcccaggccuccgggcgggugaccgugagcaccaagcgcucgcagcagacggucaucccgaacaucgggucccggcccugggugcgcggcgugucgucccggaucagcaucuacuggaccaucgucaagcccggcgacauccuccugaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucucggagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagucgggguacaaggacuggauccuguggaucuccuucgccaugagcugcuuccugcugugcgugguccuccugggcuucaucaugugggccugccagaagggcaacauccggugcaacaucugcaucuga

SEQ ID NO: 707 - RNA, 1701 nt, Artificial Sequence
  derived and/or modified CDS sequence (AUadapt) from InfluenzaA__ABB80503__HA
augaagaccaucaucgcccugucguacaucuccugccucguguucgcccagaagcugcccggcaacgacaacaacaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaacaacgagucguucaacuggaccgggguggcccagaacggcaccuccuacgccugcaagcgccggucgaucaaguccuucuucagccgccugaacuggcuccaccagcugaaguacaaguaccccgcgcugaacgugaccaugcccaacaacgacaaguucgacaagcucuacaucuggggcguccaccaccccuccacggacucggaccagaccucccuguacgcccaggccagcgggcgggugaccgugucgaccaagcgcucccagcagacggucaucccgaacaucgggagccggcccugggugcgcggcguguccucgcggaucuccaucuacuggaccaucgucaagcccggcgacauccugcucaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugcgguccggguacaaggacuggauccuguggaucucguucgccaucagcugcuuccuccugugcgugguccugcucggcuucaucaugugggccugccagaagggcaacauccgcugcaacaucugcaucuga

SEQ ID NO: 708 - RNA, 1701 nt, Artificial Sequence; identical to SEQ ID NO: 697
  derived and/or modified CDS sequence (AUadapt) from InfluenzaA__ABB80514__HA

SEQ ID NO: 709 - RNA, 1701 nt, Artificial Sequence
  derived and/or modified CDS sequence (AUadapt) from InfluenzaA__ABB80529__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccagaacggcaccucguacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucagcaucuacuggaccaucgucaagcccggcgacauccugcucaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccugaagcucgccaccggcaugcggaacguccccgacaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggguacaaggacuggauccuguggaucagcuucgccaucuccugcuuccugcugugcgugguccugcucggcuucaucaugugggccugccagaagggcaacauccggugcaacaucugcaucuga

SEQ ID NO: 710 - RNA, 1701 nt, Artificial Sequence
  derived and/or modified CDS sequence (AUadapt) from InfluenzaA__ABB80641__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcgagaacugcacccugaucgacgcccugcucggggacccccacugcgacggcuuccagaacaaggagugggaccuguucguggagcgcucgaaggccuacuccaacugcuaccccuacgacgugagcgacuacgcgucccugcggucgcucgucgccuccagcggcacgcuggaguucaacaacgaguccuucaacuggaccgggguggcccagaacggcaccucguacgccugcaagcgccgguccaucaagagcuucuucucccgccugaacuggcuccaccagcugaaguacaaguacccggcgcugaacgugaccaugcccaacaacgacaaguucgacaagcucuacaucuggggcguccaccaccccucgacggacuccgaccagaccagccuguacgcccaggccucggggcgggugaccguguccaccaagcgcagccagcagacggucauccccaacaucgggucccggccgugggugcgcggcgugucgucccggaucagcaucuacuggaccaucgucaagcccggcgacauccugcucaucaacuccaccgggaaccugaucgcgccccgcggcuacuucaagauccggucggggaaguccagcaucaugcgcuccgacgcccccaucggcaagugcaacucggagugcaucaccccgaacggcuccauccccaacgacaagcccuuccagaacgugaaccggaucacguacggggccugcccccgcuacgugaagcagaacacccugaagcucgccaccggcaugcggaacgucccggagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcgugguccugcucggcuucaucaugugggccugccagaagggcaacauccggugcaacaucugcaucuga

SEQ ID NO: 711 - RNA, 1701 nt, Artificial Sequence
  derived and/or modified CDS sequence (AUadapt) from InfluenzaA__ABB80661__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaacaacgagucguucaacuggaccgggguggcccagaacggcaccuccuacgccugcaagcgccggagcaucaaguccuucuucucgcgccugaacuggcuccaccagcugaaguacaaguaccccgcgcugaacgugaccaugcccaacaacgacaaguucgacaagcucuacaucuggggcguccaccaccccuccacggacagcgaccaggccucccuguacgcccaggccucggggcgggugaccgugagcaccaagcgcucccagcagaccgucaucccgaacaucgggucgcggcccugggugcgcggcguguccagccggaucuccaucuacuggacgaucgucaagcccggcgacauccugcucaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucaccuacggggccugcccgcgcuacgugaagcagaacacgcugaagcucgccaccggcaugcggaacguccccgagaagcagacccgcgggaucuucggcgccaucgccggguucaucgagaacggcugggagggcaugguggacgggugguacggcuuccggcaccagaacuccgaggggaccggccaggcggccgaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggucguacaacgccgagcuccugguggcgcuggagaaccagcacaccaucgaccucacggacuccgagaugaacaagcuguucgagcgcacccgcaagcagcugcgggagaacgccgaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucucguucgccaucagcugcuuccuccugugcgugguccugcucggcuucaucaugugggcgugccagaagggcaacauccggugcaacaucugcaucuga

SEQ ID NO: 712 - RNA, 1701 nt, Artificial Sequence
  derived and/or modified CDS sequence (AUadapt) from InfluenzaA__ABB80672__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggucguccaccggccgcaucugcgacagcccccaccagauccuggacgggaagaacugcacccugaucgacgcccuccugggcgacccccacugcgacggcuuccagaacaaggagugggaccuguucguggagcgguccacggccuacucgaacugcuaccccuacgacgugccggacuacgcgucccuccgcagccuggucgccuccucggggacccuggaguucaccaaggagggcuucaacuggaccgggguggcccaggacggcacguccuacgccugcaagcgggggagcgugaaguccuucuucucgcgccucaacuggcugcacaagcuggaguacaaguaccccgcgcucaacgucaccaugcccaacaacgacaaguucgacaagcuguacaucuggggcgugcaccaccccuccaccgacagcgaccagaccucccuguacgugcaggccucgggccgggucacgguguccaccaagcgcagccagcagaccgugaucccgaacaucgggucgcggcccuggguccgcggcguguccagccggaucuccaucuacuggaccaucgugaagcccggggacauccuccugaucaacucgacgggcaaccugaucgcgccccgcggcuacuucaagauccgguccggcaagagcuccaucaugcgcucggacgccccgaucgacaacugcaacuccgagugcaucacccccaacgggagcauccccaacgacaagcccuuccagaacgucaaccggaucaccuacggggccugcccgcgcuacgugaagcagaacacccucaagcuggccacgggcaugcggaacgugcccgagaagcagacccgcgggaucuucggcgccaucgccggcuucaucgagaacgggugggagggcauggucgacgggugguacggcuuccggcaccagaacuccgaggggaccggccaggccgccgaccucaagucgacccaggcggccaucaaccagaucaacggcaagcugaaccgccugaucgagaagacgaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgcggaagcagcuccgcgagaacgccgaggacaugggcaacgggugcuucaagaucuaccacaagugcgacaacgcgugcaucggcucgauccgcaacgggaccuacgaccacgacguguaccgggacgaggcccugaacaaccgcuuccagaucaagggcgucgagcugaaguccggcuacaaggacuggauccucuggaucagcuucgccaucuccugcuuccugcugugcguggugcuccugggguucaucaugugggccugccagaagggcaacauccggugcaacaucugcaucuga

SEQ ID NO: 713 - RNA, 1701 nt, Artificial Sequence
  derived and/or modified CDS sequence (AUadapt) from InfluenzaA__ABB80682__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccagaacggcaccucguacgccugcaagcgccgguccaucaagucguucuucucccgccugaacuggcuccaccagcugaaguacaaguaccccgcgcugaacgugaccaugcccaacaacgacaaguucgacaagcucuacaucuggggcguccaccaccccagcacggacuccgaccagaccucgcuguacgcccaggccagcgggcgggugaccguguccaccaagcgcucgcagcagacggucaucccgaacaucgggucccggcccugggugcgcggcgugagcucccggaucucgaucuacuggaccaucgucaagcccggcgacauccugcucaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcugcuggagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagucgggguacaaggacuggauccuguggaucagcuucgccaucuccugcuuccugcugugcgugguccuccugggcuucaucaugugggccugccagaagggcaacauccggugcaacaucugcaucuga

SEQ ID NO: 714 - RNA, 1701 nt, Artificial Sequence
  derived and/or modified CDS sequence (AUadapt) from InfluenzaA__ABB80693__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaugugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccagaacggcaccucguacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucagcaucuacuggaccaucgucaagcccggcgacauccugcucaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggguacaaggacuggauccuguggaucagcuucgccaucuccugcuuccugcugugcgugguccugcucggcuucaucaugugggccugccagaagggcaacauccggugcaacaucugcaucuga

SEQ ID NO: 715 - RNA, 1701 nt, Artificial Sequence
  derived and/or modified CDS sequence (AUadapt) from InfluenzaA__ABB80704__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaacaacgagucguucaacuggaccgggguggcccagaacggcaccuccuacgccugcaagcgccggagcaucaaguccuucuucucgcgccugaacuggcuccaccagcugaaguacaaguaccccgcgcugaacgugaccaugcccaacaacgacaaguucgacaagcucuacaucuggggcguccaccaccccuccacggacagcgaccagaccucccuguacgcccaggccucggggcgggugaccgugagcaccaagcgcucccagcagacggucaucccgaacaucgggucgcggcccugggugcgcggcguguccagccggaucuccaucuacuggaccaucgucaagcccggcgacauccugcucaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucucguucgccaucagcugcuuccuccugugcgugguccugcucggcuucaucaugugggccugccagaagggcaacauccggugcaacaucugcaucuga

SEQ ID NO: 716 - RNA, 1701 nt, Artificial Sequence; identical to SEQ ID NO: 697
  derived and/or modified CDS sequence (AUadapt) from InfluenzaA__ABB80715__HA

SEQ ID NO: 717 - RNA, 1701 nt, Artificial Sequence
  derived and/or modified CDS sequence (AUadapt) from InfluenzaA__ABB80724__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccgggguggcccagaacggcaccuccuacgccugcaagcgccggagcaucaaguccuucuucucgcgccucaacuggcugcaccagcugaaguacaaguaccccgcgcucaacgugaccaugcccaacaacgacaaguucgacaagcuguacaucuggggcguccaccaccccuccacggacagcgaccaggccucccuguacgcccaggccucggggcgggugaccgugagcaccaagcgcucccagcagaccgucaucccgaacaucgggucgcggcccugggugcgcggcguguccagccggaucuccaucuacuggacgaucgucaagcccggcgacauccuccugaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggcggccgaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcgcucgagaaccagcacaccaucgaccugacggacuccgagaugaacaagcuguucgagcgcacccgcaagcagcuccgggagaacgccgaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggguacaaggacuggauccucuggaucucguucgccaugagcugcuuccugcugugcgugguccuccugggcuucaucaugugggcgugccagaagggcaacauccggugcaacaucugcaucuga

SEQ ID NO: 718 - RNA, 1701 nt, Artificial Sequence; identical to SEQ ID NO: 703
  derived and/or modified CDS sequence (AUadapt) from InfluenzaA__ABB80737__HA

SEQ ID NO: 719 - RNA, 1701 nt, Artificial Sequence
  derived and/or modified CDS sequence (AUadapt) from InfluenzaA__ABB80748__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggucgcucgucgccuccagcggcacgcuggaguucaacaacgaguccuucaacuggaccgggguggcccagaacggcaccucguacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccucgacggacuccgaccagaccagccuguacgcccaggccucggggcgggugaccguguccacccagcgcagccagcagacggucaucccgaacaucgggucccggcccugggugcgcggcgugucgucccggaucagcaucuacuggaccaucgucaagcccggcgacauccugcucaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucucggagguggagggccggauccaggaccuggaggaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggguacaaggacuggauccuguggaucagcuucgccaucuccugcuuccugcugugcgugguccugcucggcuucaucaugugggccugccagaagggcaacauccggugcaacaucugcaucuga

SEQ ID NO: 720 - RNA, 1701 nt, Artificial Sequence
  derived and/or modified CDS sequence (AUadapt) from InfluenzaA__ABB82183__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucagcaucuacuggacgaucgucaagcccggcgacauccuccugaucaacuccaccgggaaccugaucgcgccccggggcuacuucaagauccgcucggggaaguccagcgugaugcgguccgacgccucgaucggccgcugcaacuccgagugcaucaccccgaacggcagcauccccaacgacaagcccuuccagaacgugaaccggaucaccuacggggccugcccccgcuacgucaagcagaacacgcucaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgcggaccugaaguccacgcaggccgccaucaaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggucguacaacgccgagcugcugguggcccucgagaaccagcacaccaucgaccugacggacuccgagaugaacaagcuguucgagcgcaccaagaagcagcuccgcgagaacgcggaggacaugggcaacgggugcuucaagaucuaccacaagugcgacaacgccugcaucggcagcauccggaacgggaccuacgaccacgacgucuaccgcgacgaggcccugaacaaccgguuccagaucaagggcguggagcucaagucgggguacaaggacuggauccuguggaucuccuucgccaucagcugcuuccugcugugcgucgugcuccugggcuucaucaugugggccugccagaagggcaacauccgcugcaacaucugcaucuga

SEQ ID NO: 721 - RNA, 1698 nt, Artificial Sequence; identical to SEQ ID NO: 541
  derived and/or modified CDS sequence (AUadapt) from InfluenzaA__ABB82194__HA

SEQ ID NO: 722 - RNA, 1698 nt, Artificial Sequence
  derived and/or modified CDS sequence (AUadapt) from InfluenzaA__ABB82205__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuacaagaaccugcuguggcucaccgggaagaacggccuguaccccaaccugagcaaguccuacgccaacagcaaggagaaggaggugcucguccuguggggcgugcaccacccgcccaacaucggggaccagcgcgcccuguaccacacggagaacgccuacgugagcgucguguccagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucgcggggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagucgaugggcgucuaccagauccuggccaucuacagcacgguggccuccagccucgugcugcuggucucccucggggccaucagcuucuggaugugcuccaacggcagccugcagugccgcaucugcaucuga

SEQ ID NO: 723 - RNA, 1698 nt, Artificial Sequence
  derived and/or modified CDS sequence (AUadapt) from InfluenzaA__ABB82216__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccagcuccugcagccacaacggcaaguccagcuucuaccgcaaccugcuguggcucaccgggaagaacggccuguaccccaaccuguccaagucguacgugaacaacaaggagaaggagguccucgugcuguggggcgugcaccacccgcccaacaucggggaccagcgggcccuguaccacacggagaacgccuacgucagcgugguguccagccacuacucccgccgguucacccccgagaucgccaagcgccccaagguccgggaccaggagggccgcaucaacuacuacuggacccuccuggagcccggggacaccaucaucuucgaggccaacggcaaccugaucgccccgcgguacgcguucgcccucagccgcggguucggcuccggcaucaucacgagcaacgcccccauggacgagugcgacgccaagugccagacgccccagggggccaucaacuccucgcugcccuuccagaacgugcacccggugaccaucggcgagugccccaaguacguccgguccgcgaagcugcgcauggugaccgggcuccggaacauccccagcauccagucccgcggccuguucggggccaucgccggcuucaucgagggcggguggaccggcaugguggacgggugguacggcuaccaccaccagaacgagcaggggagcggcuacgccgccgaccagaaguccacccagaacgcgaucaacggcaucaccaacaaggucaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacucggaggaguccaagcucaaccgcgagaagaucgacggcgugaagcuggagagcaugggcguguaccagauccuggccaucuacagcacgguggcguccagccucguccugcuggugucccucggggccaucagcuucuggaugugcuccaacggcagccugcagugccggaucugcaucuga

SEQ ID NO: 724 - RNA, 1701 nt, Artificial Sequence
  derived and/or modified CDS sequence (AUadapt) from InfluenzaA__ABB82227__HA
augaagaccaucaucgcccugucguacaucuucugccucacccugggccaggaccugcccgggaacgacaacuccaaggccacgcucugccugggccaccacgcggugccgaacgggacccuggucaagaccaucaccgacgaccagacggaggugaccaacgccaccgagcucgugcagucguccagcaccggcaagaucugcaacaacccccaccgcauccuggacgggauggacugcacgcugaucgacgcccuccugggcgacccccacugcgacgucuuccagaacgagaccugggaccuguucguggagcgguccaaggccuucucgaacugcuaccccuacgacgugccggacuacgccucccuccgcucgcuggcggccuccagcggcacccuggaguucaucaccgagggguucacguggaccggcgucacccagaacgggggcuccaacgccugcaagcgggggcccggcucgggcuucuucucccgccucaacuggcugaccaagucggggaacacguaccccgugcugaacgugaccaugcccaacaacgacaacuucgacaagcucuacaucuggggcguccaccacccguccaccgaccaggagcagaccagccuguacgugcaggccuccgggcgggugacggucucgacccgccggucccagcagaccaucauccccaacaucggcucgcgccccugggugcggggccugagcucccgcaucucgaucuacuggaccaucgugaagcccggggacguccucgugaucaacuccaacggcaaccugaucgcgccgcggggguacuucaagaugcgcacgggcaagucguccaucaugcggagcgacgcccccaucgacacgugcaucuccgagugcaucacccccaacgggucgauccccaacgacaagccguuccagaacaucaacaagaucaccuacggcgccugccccaaguacgugaagcagaacacccugaagcucgccaccggcaugcgcaacguccccgagaagcagacccgggggcuguucggcgccaucgcgggguucaucgagaacggcugggaggggaugaucgacggcugguacggcuuccgccaccagaacuccgaggggaccggccaggccgccgaccucaagucgacgcaggccgccaucgaccagaucaacgggaagcucaaccggaucaucgagaagaccaacgagaaguuccaccagaucgagaaggaguucuccgagguggagggccgcauccaggaccuggagaaguacguggaggacaccaagaucgaccuguggagcuacaacgcggagcuccuggucgccauggagaaccagcacaccaucgaccugacggacuccgagaugaacaagcuguucgagaagacccggcgccagcugcgggagaacgccgaggacauggggaacggcugcuucaagaucuaccacaagugcgacaacgccugcaucgagucgauccgcaacggcaccuacgaccacgacguguaccgcgacgaggcccugaacaaccgguuccagaucaaggggguggagcucaaguccggcuacaaggacuggauccuguggaucagcuucgcgaucuccugcuuccugcucugcgucgugcugcugggguucaucaugugggccugccagcgcggcaacauccggugcaacaucugcaucuga

SEQ ID NO: 725 - RNA, 1698 nt, Artificial Sequence
  derived and/or modified CDS sequence (AUadapt) from InfluenzaA__ABB83026__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgagaagaacgggcuguaccccaaccugagcaaguccuacgccaacaacaaggagaaggaggugcucauccuguggggcgugcaccacccgcccaacaucggggaccagcggacgcuguaccacaccgagaacgccuacgucucgguggugagcucccacuacagccgccgguucacccccgagaucaccaagcgccccaagguccgggaccaggagggccgcaucaacuacuacuggacgcuccuggagcccggcgacaccaucaucuucgaggccaacgggaaccugaucgccccgugguacgcguucgcccucucccggggcuucgggagcggcaucaucaccuccaacgcccccauggacgagugcgacgccaagugccagacgccccagggcgccaucaacagcucccugcccuuccagaacgugcacccggugaccaucggggagugccccaaguacguccgcucggcgaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgccgaccagaaguccacccagaacgcgaucaacggcaucacgaacaaggucaacagcgugaucgagaagaugaacacccaguucaccgccgugggcaaggaguucaacaagcuggagcgccggauggagaaccucaacaagaaggucgacgacggguuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagucgaagcucaaccgggagaagaucgacggggucaagcuggaguccaugggcguguaccagauccuggccaucuacagcaccguggcgagcucccucguccugcuggugagccucggcgccaucuccuucuggaugugcagcaacgggucccugcagugccgcaucugcaucuga

SEQ ID NO: 726 - RNA, 1698 nt, Artificial Sequence
  derived and/or modified CDS sequence (AUadapt) from InfluenzaA__ABB83127__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccucguggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacucgcgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaucuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgucaagcuggacuccaugggcguguaccagauccuggcgaucuacagcacgguggccagcucccucguccugcuggugagccucggggccaucuccuucuggaugugcagcaacggcucccugcagugccgcaucugcaucuga

SEQ ID NO: 727 - RNA, 1698 nt, Artificial Sequence
  derived and/or modified CDS sequence (AUadapt) from InfluenzaA__ABB83138__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcaucuccucguucgagcgguucgagaucuucccgaaggaguccagcuggcccaaccacacggugaccgggguguccgccagcugcucccacaacggcaagagcuccuucuaccgcaaccugcuguggcucaccgggaagaacggccuguaccccaaccugagcaaguccuacgccaacaacaaggagaaggagguccucauccuguggggcgugcaccacccgcccaacaucggggaccagcggacccuguaccacacggagaacgccuacgugucggucgugagcucccacuacagccgccgguucacccccgagaucaccaagcgccccaaggugcgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaagguggacgacggcuuccuggacaucuggaccuacaacgccgagcugcucguccugcuggagaacgagcgcacccucgacuuccacgacagcaacgugaagaaccuguacgagaaggucaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgugaagcuggacuccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 728 - RNA, 1701 nt, Artificial Sequence
  derived and/or modified CDS sequence (AUadapt) from InfluenzaA__ABB86877__HA
augaaggccauccugcucauccugcuguacaccuucaccgccaccaacgcggacacccucugcaucggcuaccacgccaacaacucgaccgacaccguggacacgguccuggagaagaacgugaccgugacccacuccgucaaccugcucgaggaccgccacaacgggaagcugugcaaccugggcgggaucgcgccccucuaccugggcaacugcaacaucgccggguggcugcucggcaacccggagugcgagcugcuguucaccgugagcuccuggucguacaucguggagacguccaacagcgacaacgggaccugcuaccccggcgacuucaucaacuacgaggagcuccgggagcagcuguccucgauguccagcuacgagcgcuucgagaucuuccccaaggaguccucguggcccaaccacgagaccaaccggggcgucaccgccgccugcccguacgccggggccaacuccuucuaccgcaaccugaucuggcucgugaagaagggcaacagcuaccccaagaucaacaaguccuacgugaacaacaaggagaaggagguccuggugcugugggggauccaccacccgcccacgucggccgaccagcagucccucuaccagaacgcggacgccuacgugagcgucgaguccucgaaguacaacaagaaguucaagcccgagaucgccacccggcccaaggugcgcggccaggccggccggaugaacuacuacuggacccugguggagcccggggacaccaucacguucgaggccaccggcaaccuggucgugccccgcuacgcguucgccaugaaccgggggagcggcuccggcaucaucaucucggacaccccggugcacgacugcaacaccacgugccagacccccaagggggccaucaacaccucccuccccuuccagaacguccaccccgugaccaucggcgagugcccgaaguacgucaagagcacgaagcugcgcauggccaccgggcugcggaacauccccuccauccagucgcgcggccucuucgaggccaucgcgggguucaucgagggcggcuggaccgggaugaucgacggcugguacggguaccaccaccagaacgagcagggcuccggguacgccgccgaccgcaagagcacccagaacgccaucgacggcaucacgaacaaggugaacuccgugaucgagaagaugaacacccaguucaccgccgugggcaaggaguucaaccaccuggagaagcggaucgagaaccugaacaagaaggucgacgacggguuccucgacguguggaccuacaacgcggagcugcugguccuccuggagaacgagcggacgcuggacuuccacgacucgaacgugaagaaccucuacgagaaggugcgcucccagcugcggaacaacgccaaggagaucggcaacgggugcuucgaguucuaccacaagugcgacgacacgugcauggagagcguccgcaacggcaccuacgacuaccugaaguacuccgaggagucgaagcucaaccgggagaagaucgagggggugaagcuggacuccgcccgcaucuaccagauccuggccaucuacagcaccguggccuccucgcucguccugcuggugucccucggcgcgaucagcuucuggaugugcagcaacggcucccugcagugccggaucugcaucuga

SEQ ID NO: 729 - RNA, 1701 nt, Artificial Sequence
  derived and/or modified CDS sequence (AUadapt) from InfluenzaA__ABB86887__HA
augaaggccauccugcucauccugcuguacaccuucaccgccaccaacgcggacacccucugcaucggcuaccacgccaacaacucgaccgacaccguggacacgguccuggagaagaacgugaccgugacccacuccgucaaccugcucgaggaccgccacaacgggaagcugugcaaccugggcgggaucgcgccccucuaccugggcaacugcaacaucgccggguggcugcucggcaacccggagugcgagcugcuguucaccgugagcuccuggucguacaucguggagacguccaacagcgacaacgggaccugcuaccccggcgacuucaucaacuacgaggagcuccgggagcagcuguccucgauguccagcuacgagcgcuucgagaucuuccccaaggaguccucguggcccaaccacgagaccaaccggggcgucaccgccgccugcccguacgccggggccaacuccuucuaccgcaaccugaucuggcucgugaagaagggcaacagcuaccccaagaucaacaaguccuacgugaacaacaaggagaaggagguccuggugcugugggggauccaccacccgcccacgucggccgaccagcagucccucuaccagaacgcggacgccuacgugagcgucgaguccucgaaguacaacaagaaguucaagcccgagaucgccacccggcccaaggugcgcggccaggccggccggaugaacuacuacuggacccugguggagcccggggacaccaucacguucgaggccaccggcaaccuggucgugccccgcuacgcguucgccaugaagcgggggagcggcuccggcaucaucaucucggacaccccggugcacgacugcaacaccacgugccagacccccaagggggccaucaacaccucccuccccuuccagaacauccaccccgucaccaucggcgagugcccgaaguacgucaagagcacgaagcugcgcauggccaccgggcugcggaacauccccuccauccagucgcgcggccucuucggggccaucgcgggcuucaucgagggcggguggaccggcaugaucgacgggugguacggcuaccaccaccagaacgagcagggguccggcuacgccgccgaccgcaagagcacccagaacgccaucgacggcaucacgaacaaggugaacuccgugaucgagaagaugaacacccaguucaccgccguggggaaggaguucaaccaccuggagaagcggaucgagaaccugaacaagaagguggacgacggcuuccucgacgucuggaccuacaacgcggagcugcuggugcuccuggagaacgagcggacgcuggacuuccacgacucgaacgucaagaaccucuacgagaaggugcgcucccagcugcggaacaacgccaaggagaucgggaacggcugcuucgaguucuaccacaagugcgacgacacgugcauggagagcgugcgcaacgggaccuacgacuaccugaaguacuccgaggagucgaagcucaaccgggagaagaucgagggcgucaagcuggacuccgcccgcaucuaccagauccuggccaucuacagcaccguggccuccucgcucgugcugcuggucucccucggcgcgaucagcuucuggaugugcagcaacgggucccugcagugccggaucugcaucuga

SEQ ID NO: 730 - RNA, 1698 nt, Artificial Sequence
  derived and/or modified CDS sequence (AUadapt) from InfluenzaA__ABB86899__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggucguacaucgucgagacccccaaccccgagaacggcgccugcuaccccggccacuucgccgacuacgaggagcugcgcgagcagcucuccagcguguccagcuucgagcgguucgagaucuucccgaaggaguccagcuggcccaaccacacgaucaccgggguguccgccucgugcucccacaacggcaagcgcagcuucuaccggaaccugcuguggcucaccgggaagaacggccuguaccccaaccuguccaagagcuacgccaacaacaaggagaaggagguccucauccuguggggcgugcaccacccgcccaacaucggggaccagcgcacccuguaccacacggagaacgccuacguguccgucgugucgagccacuacucccggcgcuucacccccgagaucaccaagcggcccaaggugcgcgaccaggagggccggaucaacuacuacuggacccuccuggagcccggggacacgaucaucuucgaggccaacggcaaccugaucgcgccgugguacgccuucgcccucagccgcggguucggcuccggcaucaucaccagcaacgcccccauggacgagugcgacgccaagugccagacgccccagggggcgaucaacuccucgcugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacucggucaucgagaagaugaacacgcaguucaccgccguggggaaggaguucuccaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggucaaggggcagcugaagaacaacgccaaggagaucggcaacgggugcuucgaguucuaccacaagugcaacaacgagugcauggaguccgugaagaacggcacguacgacuaccccaaguacagcgaggaguccaagcucaaccgcgagaagaucgacggcgugaagcuggacagcaugggggucuaccagauccuggcgaucuacuccaccguggccucgagccucauccugcuggugucccucggcgccaucagcuucuggaugugcuccaacgggagccugcagugccggaucugcaucuga

SEQ ID NO: 731 - RNA, 1701 nt, Artificial Sequence
  derived and/or modified CDS sequence (AUadapt) from InfluenzaA__ABB86907__HA
augaaggccauccugcucgugcugcuguacaccuucaccucgacgaacgccgacacccucugcaucggcuaccacgcgaacaacuccaccgacaccgucgacacggugcuggagaagaacgugaccgucacccacucggugaaccugcucgaggacaagcacaacgggaagcugugccgccugggcgggaucgcgccccuccaccugggcaagugcaacaucgccggguggcugcucggcaacccggagugcgaccugcugcucaccguguccagcugguccuacaucgucgagacgucgaacuccuacaacgggaccugcuaccccggggacuucaccaacuacgaggagcugcgggagcagcugagcuccgugucguccuucgagcgcuucgagaucuuccccaaggccagcuccuggcccaaccacgagaccaaccggggcgugacggccgccugcccgcacgccgggaccaacucguucuaccgcaaccucaucuggcuggucaagaagggcaacaccuaccccaagcuguccaagucguacgugaacaacaaggggaaggaggugcucguccuguggggcauccaccaccccuccaccagcacggaccagcagucccuguaccagaacgccgacaccuacguguucgugggcaccucgaaguacaacaagaaguucaagcccgagaucgccguccggccgaaggugaaggaccaggcggggcgcaugaacuacuacuggacccucguggagcccggcgacacgaucaccuucgaggccaccgggaaccuggucgugccccgguacgccuucgccaugaaccgcggccacggcagcgggaucaucaucuccgacacccccgugcacgacugcaacacgaccugccagaccccgaagggcgccaucaacaccucgcugcccuuccagaacguccaccccgugacgaucgggaagugccccaaguacgugaaguccacccggcuccgcauggcgaccggccugcggaacaucccgagcauccagucccgcgggcuguucggcgccaucgccggcuucaucgagggcggcuggaccgggaugaucgacggcugguacggguaccaccaccagaacggccagggcucgggguacgccgccgaccagaaguccacgcagaacgcgaucgacggcaucaccaacaaggucaacucggugaucgagaagaugaacacccaguucaccgccgucgggaaggaguucaaccaccucgagaagcggaucgagaaccugaacaagaagguggacgacggcuuccuggacguguggacguacaacgccgagcuccugguccugcucgagaacgagcgcacccuggacuuccacgacuccaacgugaagaaccuguacgagaaggugcggcgccagcucaagaacaacgccaaggagaucgggaacggcugcuucgaguucuaccacaacugcgacgacgccugcauggagagcgucaagaacggcaccuacgacuaccccaaguacuccgaggagucgcggcugaaccgcgaggagaucaacgggaucaagcuggacuccacccggaucuaccagauccucgcgaucuacagcaccguggccuccucguccgugcugcuggucagccucggcgccaucuccuucuggaugugcucgaacgggagccugcagugccgcaucugcaucuga

SEQ ID NO: 732 - RNA, 1698 nt, Artificial Sequence
  derived and/or modified CDS sequence (AUadapt) from InfluenzaA__ABB86917__HA
augaaggugaagcugcucauccugcugugcaccuucaccgccacguacgccgaccccaucugcaucggcuaccacgcgaacaacucgaccgacaccgucgacaccgugcucgagaagaacguggccgucacgcacuccgugaaccugcuggaggacagccacaacgggaagcucugccugcugaagggcaucgccccgcuccagcuggggaacugcuccguggccggcuggauccuggggaaccccgagugcgagcuccugaucagcaaggaguccuggagcuacaucgucgagacccccaaccccgagaacggcgccugcuacccgggcuacuucgcggacuacgaggagcugcgcgagcagcucuccagcguguccucguucgagcgguucgagaucuuccccaaggaguccagcuggcccaaccacaccgugaccggggucuccgccagcugcucccacaacggcaagagcuccuucuaccgcaaccugcuguggcucacggggaagaacggccuguaccccaaccugagcaaguccuacgccaacaacaaggagaaggaggugcucauccuguggggcgugcaccacccgcccaacaucggggaccagcggacccuguaccacaccgagaacgccuacgucucgguggugagcucccacuacagccgccgguucacccccgagaucacgaagcgccccaagguccgggaccaggagggccgcaucaacuacuacuggacccuccuggagccgggggacaccaucaucuucgaggcgaacggcaaccugaucgcccccugguacgccuucgcccucucccggggguucggcagcggcaucaucaccuccaacgcccccauggacgagugcgacgcgaagugccagacgccccagggggccaucaacagcucccugccguuccagaacgugcaccccgugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacagcaacgucaagaaccuguacgagaaggugaagucccagcugaagaacaacgcgaaggagaucgggaacggcugcuucgaguucuaccacaagugcaacaacgagugcauggagagcgugaagaacgggaccuacgacuacccgaaguacuccgaggagucgaagcucaaccgggagaagaucgacggcgucaagcuggacuccaugggcguguaccagauccuggccaucuacagcaccguggccagcucccucguccugcuggugagccucggggccaucuccuucuggaugugcagcaacggcucccugcagugccgcaucugcaucuga

SEQ ID NO: 733 - RNA, 1698 nt, Artificial Sequence
  derived and/or modified CDS sequence (AUadapt) from InfluenzaA__ABB86929__HA
augaaggugaagcugcucauccugcuguacaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggucguacaucgucgagacccccaaccccgagaacggcgccugcuaccccggccacuucgccgacuacgaggagcugcgcgagcagcucuccagcguguccagcuucgagcgguucgagaucuucccgaaggaguccagcuggcccaaccacacgaucaccgggguguccgccucgugcucccacaacggcaagcgcagcuucuaccggaaccugcuguggcucaccgggaagaacggccuguaccccaaccuguccaagagcuacgccaacaacaaggagaaggagguccucauccuguggggcgugcaccacccgcccaacaucggggaccagcgcacccuguaccacacggagaacgccuacguguccgucgugucgagccacuacucccggcgcuucacccccgagaucaccaagcggcccaaggugcgcgaccaggagggccggaucaacuacuacuggacccuccuggagcccggggacacgaucaucuucgaggccaacggcaaccugaucgcgccgugguacgccuucgcccucagccgcggguucggcuccggcaucaucaccagcaacgcccccauggacgagugcgacgccaagugccagacgccccagggggcgaucaacuccucgcugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacucggucaucgagaagaugaacacgcaguucaccgccguggggaaggaguucuccaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggucaaggggcagcugaagaacaacgccaaggagaucggcaacgggugcuucgaguucuaccacaagugcaacaacgagugcauggaguccgugaagaacggcacguacgacuaccccaaguacagcgaggaguccaagcucaaccgcgagaagaucgacggcgugaagcuggacagcaugggggucuaccagauccuggcgaucuacuccaccguggccucgagccucauccugcuggugucccucggcgccaucagcuucuggaugugcuccaacgggagccugcagugccggaucugcaucuga

SEQ ID NO: 734 - RNA, 1701 nt, Artificial Sequence
  derived and/or modified CDS sequence (AUadapt) from InfluenzaA__ABB86937__HA
augaaggccauccugcucgugcugcuguacaccuucaccucgacgaacgccgacacccucugcaucggcuaccacgcgaacaacuccaccgacaccgucgacacggugcuggagaagaacgugaccgucacccacagcgugaaccugcucgaggacaagcacaacgggcgccugugcaagcugggcgggaucgcgccccuccaccugggcaagugcaacaucgccggguggcugcucggcaacccggagugcgagcugcuguucaccguguccucgugguccuacaucgucgagacgagcaacuccuacaacgggaccugcuaccccggcgacuucaucaacuacgaggagcuccgggagcagcugucguccgugagcuccuucgagcgcuucgagaucuuccccaaggccucguccuggcccaaccacgagaccaaccggggcgugaccgccgccugcccgcacgccgggacgaacagcuucuaccgcaaccugaucuggcucgucaagaagggcaacaccuaccccaagaucuccaagucguacgugaacaacaaggggaaggaggugcugguccuguggggcauccaccaccccuccaccagcaacgaccagcagucccucuaccagaacgccgacaccuacguguucgugggccccucgaaguacaacaagaaguucaagccggagaucgccacgcggcccaagguccgcgaccaggcggggcggaugaacuacuacuggacccugguggagcccggcgacaccaucaccuucgaggccacggggaaccugguggucccccgcuacgccuucgccaugaaccggggcagcgaguccggcaucaucaucucggacaccccggugcacgacugcaacacgaccugccagacccccaagggggccaucaacaccucccuccccuuccagaacgugcaccccgucaccaucggcgagugcccgaaguacgucaagagcacccgccugcggauggcgacggggcugcgcaacauccccuccauccagucgcggggccucuucggggccaucgccggcuucaucgaggagggcuggaccgggaugaucgacggcugguacggguaccaccaccagaacggccagggguccggcuacgccgccgaccagaaguccacccagaacgcgaucgacggcaucaccaacaaggugaacagcgugaucgagaagaugaacacgcaguucaccgccguggggaaggaguucaaccaccuggagaagcgcaucgagaaccugaacaagaaggucgacgacggcuuccucgacguguggaccuacaacgccgagcugcuggugcuccuggagaacgagcggacccuggacuuccacgacucgaacgucaagaaccucuacgagaaggugcgccggcagcugaagaacaacgccaaggagaucgggaacggcugcuucgaguucuaccacaagugcgacgacgccugcauggaguccgugaagaacgggacguacgacuaccccaaguacagcgaggagucccgccugaaccgggaggagaucaacggcaucaagcucgacucgacccgcaucuaccagauccuggcgaucuacuccaccgucgccagcuccucggugcugcucgugucccugggcgccaucagcuucuggaugugcagcaacgggucccugcagugccggaucugcaucuga

SEQ ID NO: 735 - RNA, 1701 nt, Artificial Sequence
  derived and/or modified CDS sequence (AUadapt) from InfluenzaA__ABB86946__HA
augaaggccauccugcucgugcugcuguacaccuucaccgccgcgaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugcggggcaucgcgccccuccaccuggggaagugcaacaucgccggcuggcugcucgggaacccggagugcgagucgcuguccaccgugagcuccuggucguacaucgucgagaccuccaacagcgacaacggcacgugcuaccccggcgacuucaucaacuacgaggagcugcgcgagcagcucuccucgguguccagcuucgagcgguucgagaucuuccccaaggccuccucguggcccaaccacgagaccaaccgcgggaccaccgccgccugcccguacgccggcgcgaacuccuucuaccggaaccugaucuggcuggugaagaaggggaacucguaccccaagcucaacaaguccuacgucaacaacaagggcaaggaggugcuggugcugugggggauccaccaccccagcacguccaacgagcagcagucgcucuaccagaacgccgacaccuacgucuucgugggcagcuccaaguacaacaagaaguucaagcccgagaucgccacccgcccgaaggugcgggaccaggccggccgcaugaacuacuacuggacccugaucgagcccggggacacgaucaccuucgaggccaccggcaaccuggucgugccccgguacgcguucgccaugaaccgcgggucgggcuccggcaucaucaucagcgacacccccgugcacgacugcaacacgaccugccagaccccgaagggggccaucaacaccucccuccccuuccagaacguccaccccgugacgaucggcgagugccccaaguacgucaagucgaccaagcugcggauggccaccgggcugcgcaacaucccguccauccagagccggggccucuucggggccaucgcgggcuucaucgagggcggguggaccggcaugaucgacgggugguacggcuaccaccaccagaacgagcagggguccggcuacgccgccgaccagaaguccacgcagaacgccaucgacggcaucaccaacaaggugaacucggugaucgagaagaugaacacccaguucaccgccguggggaaggaguucaaccaccuggagaagcgcaucgagaaccugaacaagaaggucgacgacggcuuccucgacguguggacguacaacgcggagcugcugguccuccuggagaacgagcggacccuggacuuccacgacucgaacgugaagaaccucuacgagaaggugcgcucccagcugaagaacaacgccaaggagaucgggaacggcugcuucgaguucuaccacaagugcgacgacgccugcauggagagcgucaagaacgggaccuacgacuaccccaaguacuccgaggagucgcggcugaaccgcgaggagaucgacggcaucaagcucgacuccacccggaucuaccagauccuggccaucuacagcacgguggccuccucgagcgugcugcucgucucccugggcgcgaucucguucuggaugugcuccaacgggagccugcagugccgcaucugcaucuga

SEQ ID NO: 736 - RNA, 1701 nt, Artificial Sequence
  derived and/or modified CDS sequence (AUadapt) from InfluenzaA__ABB96319__HA
augaagaccaucaucgcccugucguacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccucgaccgggcgcaucugcgacaacccccaccggauccuggacggcaagaacugcacccucaucgacgcccugcugggggacccccacugcgacggcuuccagaacgagaagugggaccucuucguggagcgcuccaaggccuucagcaacugcuaccccuacgacgugccggacuacgcgucccugcggucgcuggucgccuccagcggcacgcucgaguucuucaacgagggguucaacuggaccggcgugacccagaacgggggcuccuacgccugcaagcgcgggcccgacaacucguucuucucccggcugaacuggcuguacaagagcgaguccaccuaccccgugcucaacgucacgaugcccaacaacgacaacuucgacaagcuguacaucuggggcgugcaccacccgucgaccgacaaggagcagaccaaccuguacgugcaggccuccggccgcgucaccgugagcacgaagcggucccagcagaccaucauccccaacguggggccccgccccuggguccggggccucucgagccgcaucuccaucuacuggaccaucgugaagccgggggacgugcugcugaucaacucgaacggcaaccucaucgcgccccggggcuacuucaagauccgcaccgggaaguccagcaucaugcgguccgacgcccccaucggcacgugcucguccgagugcaucacccccaacgggagcaucccgaacgacaagcccuuccagaacgucaacaagaucaccuacggcgccugccccaaguacgugaagcagaacacccugaagcuggccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagucgacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccucuggagcuacaacgcggagcugcuggucgcccucgagaaccagcacaccaucgaccugaccgacuccgagaugaacaagcuguucgagaagacgcggcgccagcuccgggagaacgccgaggacauggggaacggcugcuucaagaucuaccacaagugcgacaacgccugcaucgggucgauccgcaacggcaccuacgaccacgacguguaccgcgacgaggcccugaacaaccgguuccagaucaagggcgucgagcugaaguccggguacaaggacuggauccucuggaucagcuucgcgaucuccugcuuccugcugugcguggugcuccugggcuucaucaugugggccugccagaaggggaacauccgcugcaacaucugcaucuga

SEQ ID NO: 737 - RNA, 1701 nt, Artificial Sequence
  derived and/or modified CDS sequence (AUadapt) from InfluenzaA__ABB96330__HA
augaagaccaucaucgcccugucguacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccucgaccgggcgcaucugcgacaacccccaccggauccuggacggcaagaacugcacccucaucgacgcccugcugggggacccccacugcgacggcuuccagaacgagaagugggaccucuucguggagcgcuccaaggccuucagcaacugcuaccccuacgacgugccggacuacgcgucccugcggucgcuggucgccuccagcggcacgcucgaguucuucaacgagggguucaacuggaccggcgugacccagaacgggggcuccuacgccugcaagcgcgggcccgacaacucguucuucucccggcugaacuggcuguacaagagcgaguccaccuaccccgugcucaacgucacgaugcccaacaacgacaacuucgacaagcuguacaucuggggcgugcaccacccgucgaccgacaaggagcagaccaaccuguacgugcaggccuccggccgcgucaccgugagcacgaagcggucccagcagaccaucauccccaacguggggucgcgccccuggguccggggccucagcucccgcaucucgaucuacuggaccaucgugaagcccggggacgugcugcugaucaacuccaacggcaaccucaucgcgccgcggggcuacuucaagauccgcaccggcaagagcuccaucaugcggucggacgcccccaucgggacgugcuccagcgagugcaucacccccaacggguccauccccaacgaccgcccguuccagaacgucaacaagaucaccuacggcgccugccccaaguacgugaagcagaacacccugaagcuggccacggggaugcggaacgugcccgagaagcagacccgcggcaucuucggcgccaucgcgggguucaucgagaacggcugggaggggauggucgacggcugguacggguuccggcaccagaacucggagggcaccggccaggccgccgaccucaaguccacccaggccgccaucgaccagaucaacgggaagcugaaccgcgugaucgagaagacgaacgagaaguuccaccagaucgagaaggaguucagcgagguggagggccggauccagaaccuggagaaguacgucgaggacaccaagaucgaccucugguccuacaacgcggagcugcugguggcccucgagaaccagcacaccaucgaccugaccgacucggagaugaacaagcuguucgagaagacgcgccggcagcuccgcgagaacgccgaggacauggggaacggcugcuucaagaucuaccacaagugcgacaacgccugcaucggguccauccgcaacggcaccuacgaccacgacgucuaccgggacgaggcccugaacaaccgcuuccagaucaagggcguggagcucaagagcggguacaaggacuggauccuguggaucuccuucgcgaucagcugcuuccugcugugcgugguccuccugggcuucaucaugugggccugccagaaggggaacauccggugcaacaucugcaucuga

SEQ ID NO: 738 - RNA, 1701 nt, Artificial Sequence
  derived and/or modified CDS sequence (AUadapt) from InfluenzaA__ABB96341__HA
augaagaccaucaucgcccugucguacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccucgaccgggcgcaucugcgacaacccccaccggauccuggacggcaagaacugcacccucaucgacgcccugcugggggacccccacugcgacggcuuccagaacgagaagugggaccucuucguggagcgcuccaaggccuucagcaacugcuaccccuacgacgugccggacuacgcgucccugcggucgcuggucgccuccagcggcacgcucgaguucuucaacgagggguucaacuggaccggcgugacccagaacgggggcuccuacgccugcaagaaggggcccgacaacucguucuucucccgccugaacuggcuguacaagagcgaguccaccuaccccgugcucaacgucacgaugcccaacaacgacaacuucgacaagcuguacaucuggggcgugcaccacccgucgaccgacaaggagcagaccaaccuguacgugcaggccuccggccgggucaccgugagcacgaagcgcucccagcagaccaucauccccaacguggggucgcggcccuggguccgcggccucagcucccggaucucgaucuacuggaccaucgugaagcccggggacgugcugcugaucaacuccaacggcaaccucaucgcgccgcgcggcuacuucaagauccggaccggcaagagcuccaucaugcgcucggacgcccccaucgggacgugcuccagcgagugcaucacccccaacggguccauccccaacgacaagccguuccagaacgucaacaagaucaccuacggcgccugccccaaguacgugaagcagaacacccugaagcuggccacggggaugcggaacgugcccgagaagcagacccgcggcaucuucggcgccaucgcgggguucaucgagaacggcugggaggggaugaucgacggcugguacggguuccggcaccagaacucggagggcaccggccaggccgccgaccucaaguccacccaggccgccaucgaccagaucaacgggaagcugaaccgcgucaucgagaagacgaacgagaaguuccaccagaucgagaaggaguucagcgagguggagggccggauccaggaccuggagaaguacguggaggacaccaagaucgaccucugguccuacaacgcggagcugcuggucgcccucgagaaccagcacaccaucgaccugaccgacucggagaugaacaagcuguucgagaagacgcgccggcagcuccgcgagaacgccgaggacauggggaacggcugcuucaagaucuaccacaagugcgacaacgccugcaucggguccauccggaacggcaccuacgaccacgacguguaccgcgacgaggcccugaacaaccgcuuccagaucaagggcgucgagcucaagagcggguacaaggacuggauccuguggaucuccuucgcgaucagcugcuuccugcugugcguggugcuccugggcuucaucaugugggccugccagaaggggaacauccggugcaacaucugcaucuga

SEQ ID NO: 739 - RNA, 1701 nt, Artificial Sequence
  derived and/or modified CDS sequence (AUadapt) from InfluenzaA__ABB96395__HA
augaagaccaucaucgcccugucguacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccucgaccgggcgcaucugcgacagcccccaccggauccuggacggcaagaacugcacccucauggacgcccugcugggggacccccacugcgacggcuuccagaacgagaagugggaccucuucguggagcgcuccaaggccuucuccaacugcuaccccuacgacgugccggacuacgcgucgcugcggucccuggucgccagcuccggcacgcucgaguucaucaacgagggguucaacuggaccggcgugacccagaacgggggcucguacgccugcaagcgcgggcccgacaacuccuucuucagccggcugaacuggcuguacaaguccgagucgaccuaccccgugcucaacgucacgaugcccaacaacgacaacuucgacaagcuguacaucuggggcgugcaccacccguccaccgacaaggagcagaccaaccuguacgugcaggccagcggccgcgucaccguguccacgaagcggucgcagcagaccaucauccccaacguggggagccgccccuggguccggggccucuccucgcgcaucuccaucuacuggaccaucgugaagcccggggacauccugcugaucaacagcaacggcaaccucaucgcgccgcggggcuacuucaagauccgcaccgggaaguccucgaucaugcgguccgacgcccccaucggcacgugcagcuccgagugcaucacccccaacgggucgauccccaacgacaagccguuccagaacgugaacaagaucaccuacggcgccugccccaaguacgucaagcagaacacccugaagcuggccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagagcacccaggccgccaucgaccagaucaacgggaagcugaaccgggugaucgagcgcacgaacgagaaguuccaccagaucgagaaggaguucuccgaggucgagggccggauccaggaccuggagaaguacguggaggacaccaagaucgaccucuggucguacaacgcggagcugcugguggcccucgagaaccagcacaccaucgaccugaccgacuccgagaugaacaagcuguucgagaagacgcgccggcagcuccgcgagaacgccgaggacauggggaacggcugcuucaagaucuaccacaagugcgacaacgccugcaucgggagcauccgcaacggcaccuacgaccacgacgucuaccgggacgaggcccugaacaaccgcuuccagaucaagggcguggagcugaaguccggguacaaggacuggauccucuggaucagcuucgcgaucuccugcuuccugcugugcgucgugcuccugggcuucaucaugugggccugccagaaggggaacauccggugcaacaucugcaucuga

SEQ ID NO: 740 - RNA, 1698 nt, Artificial Sequence
  derived and/or modified CDS sequence (AUadapt) from InfluenzaA__ABB96487__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaagaaguccagcuggcccaaccacacggugaccggggucuccgccagcugcucccacgacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucucgguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 741 - RNA, 1701 nt, Artificial Sequence
  derived and/or modified CDS sequence (AUadapt) from InfluenzaA__ABB96520__HA
augaagaccaucaucgcccugucguacaucuucugccucgcccugggccaggaccugcccgggaacggcaacuccaccgcgacgcucugccuggggcaccacgccgugccgaacggcacccuggucaagaccaucaccgacgaccagaucgaggugacgaacgccaccgagcucgugcagucguccagcaccgggaagaucugcaacaacccccaccgcauccuggacggcaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucggggacccuggaguucaucaccgagggcuucaccuggacgggggugacccagaacggcggguccaacgccugcaagcggggccccggcagcggguucuucucccgccucaacuggcugaccaagucgggcuccaccuaccccgugcugaacgucacgaugcccaacaacgacaacuucgacaagcucuacaucuggggcgugcaccacccgagcaccgaccaggagcagaccucccuguacgugcaggccucggggcgggucaccguguccacgcgccggagccagcagaccaucauccccaacaucggcucgcgccccugggugcgggggcuguccagccgcaucuccaucuacuggaccaucgucaagcccggcgacgugcucgugaucaacucgaacgggaaccugaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggcgccugccccaaguacgugaagcagaagacccugaagcucgccacggggaugcgcaacauccccgagaagaagacccggggcaucuucggggccaucgcgggcuucaucgagaacgggugggagggcaugaucgacggcugguacggguuccgccaccagaacagcgagggcaccgggcaggccgccgaccugaaguccacccaggccgccaucgaccagaucaacggcaagcugaaccgggugaucgagaagacgaacgagaaguuccaccagaucgagaaggaguucucggaggucgaggggcgcauccaggaccucgagaaguacguggaggacaccaagaucgaccugugguccuacaacgcggagcugcucguggcccuggagaaccagcacaccaucgaccugaccgacagcgagaugaacaagcuguucgagaagacgcggcgccagcuccgggagaacgccgaggacaugggcaacggcugcuucaagaucuaccacaagugcgacaacgccugcaucgaguccauccgcaacgggaccuacgaccacgacgucuaccgcgacgaggcccugaacaaccgguuccagaucaagggcguggagcucaagucgggguacaaggacuggauccuguggaucuccuucgcgaucagcugcuuccugcucugcgucgugcugcugggcuucaucaugugggccugccagcgcggcaacauccggugcaacaucugcaucuga

SEQ ID NO: 742 - RNA, 1701 nt, Artificial Sequence
  derived and/or modified CDS sequence (AUadapt) from InfluenzaA__ABB96531__HA
augaagaccaucaucgcccugucguacauccucugccugguguccgcccagaagauccccggcaacgacucguccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcgagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaacaacgagagcuucaacuggaccgggguggcccagaacggcaccuccuacgccugcaagcgccggucgaucaaguccuucuucagccgccugaacuggcuccaccagcugaaguacaaguaccccgcgcugaacgugaccaugcccaacaacgacaaguucgacaagcucuacaucuggggcguccaccaccccuccacggacucggaccagaccucgcuguacgcccaggccuccgggcgggugaccgugagcaccaagcgcucccagcagacggucaucccgaacaucgggucgcggcccugggugcgcggcguguccagccggaucuccaucuacuggaccaucgucaagcccggcgacauccugcucaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcucaagucgggguacaaggacuggauccuguggaucuccuucgccaucagcugcuuccugcugugcgugguccugcucggcuucaucaugugggccugccagaagggcaacauccggugcaacaucugcaucuga

SEQ ID NO: 743 - RNA, 1701 nt, Artificial Sequence
  derived and/or modified CDS sequence (AUadapt) from InfluenzaA__ABC02234__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcgagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccuacgccugcaagcgccggagcaucaaguccuucuucucgcgccucaacuggcugcaccagcugaaguacaaguaccccgcgcucaacgugaccaugcccaacaacgacaaguucgacaagcuguacaucuggggcguccaccaccccuccacggacagcgaccagaccucccuguacgcccaggccucggggcgggugaccgugagcaccaagaucucccagcagacggucaucccgaacaucgggucgcgccccugggugcggggcguguccagccgcaucuccaucuacuggaccaucgucaagcccggcgacauccuccugaucaacagcaccgggaaccugaucgcgccccggggcuacuucaagauccgcuccgggaaguccuccaucaugcggucggacgccccgaucggcaagugcaacuccgagugcaucacccccaacggcagcauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacuccgaggggacgggccaggccgcggaccucaagucgacccaggccgccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacgggugcuucaagaucuaccacaagugcgacaacgccugcaucggcucgauccggaacgggaccuacgaccacgacguguaccgcgacgaggcccugaacaaccgguuccagaucaagggcgucgagcugaaguccggguacaaggacuggauccucuggaucagcuucgccaugagcugcuuccuguucugcgugguccugcucggcuucaucaugugggccugccagaagggcaacauccgcugcaacaucugcaucuga

SEQ ID NO: 744 - RNA, 1701 nt, Artificial Sequence
  derived and/or modified CDS sequence (AUadapt) from InfluenzaA__ABC02255__HA
augaagaccaucaucgcccugucguacaucuucugccucgugcuggcccaggaccugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggaagaucugcaacaacccccaccgcauccuggacggcaucaacugcacccugaucgacgcccuccugggggacccccacugcgacggcuuccagaacgagaagugggaccuguucguggagcgguccaaggccuucucgaacugcuaccccuacgacgugccggacuacgcgucccuccgcagccuggucgccuccucgggcacgcuggaguucaucaacgagggguucaacuggaccggcgugacccagaacgggggcuccaacgccugcaagcgggggcccgacagcggcuucuucucccgccucaacuggcuguacaagucgggcuccaccuaccccgugcugaacgucacgaugcccaacaacgacaacuucgacaagcucuacaucuggggcgugcaccacccgucgaccgaccaggagcagaccaaccuguacgugcaggccuccgggcgggucaccgugagcacgaagcgcucccagcagaccaucauccccaacguggggucgcggcccuggguccgcggccugagcucccggaucucgaucuacuggaccaucgugaagcccggcgacauccucgugaucaacuccaacgggaaccugaucgcgccgcgcggccacuucaagaugcggaccggcaagagcuccaucaugcgcucggacgcccccaucgggacgugcuccucggagugcaucacccccaacggguccauccccaacgacaagccguuccagaacgucaacaagaucaccuacggcgccugccccaaguacgugaagcagaacacccugaagcucgccacgggcaugcggaacgugcccgagaagcagacccgcgggaucuucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcugaaccgcgucaucgagaagacgaacgagaaguuccaccagaucgagaaggaguucucggagguggagggccggauccaggaccucgagaaguacguggaggacaccaagaucgaccugugguccuacaacgcggagcugcucgucgcccuggagaaccagcacaccaucgaccugaccgacagcgagaugaacaagcuguucgagaagacgcgccggcagcuccgcgagaacgccgaggacauggggaacggcugcuucaagaucuaccacaagugcgacaacgccugcaucggcuccauccggaacgggaccuacgaccacgacguguaccgcgacgaggcccugaacaaccgcuuccagaucaagggcgucgagcucaagucgggguacaaggacuggauccuguggaucuccuucgcgaucagcugcuuccugcucugcguggugcugcugggcuucaucaugugggccugccagaagggcaacauccggugcaacaucugcaucuga

SEQ ID NO: 745 - RNA, 1701 nt, Artificial Sequence
  derived and/or modified CDS sequence (AUadapt) from InfluenzaA__ABC02266__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcucgcucgucgccuccagcggcacgcuggaguucaucaacgagggguucaacuggaccggcgugacccagaacgggggcucccgggccugcaagcgcgggcccgacaacggcuucuucucgcggcugaacuggcucuacaaguccggcagcaccuaccccgugcagaacgucacgaugcccaacaacgacaacuccgacaagcuguacaucuggggcgugcaccacccgucgaccgacaaggagcagaccgaccuguacgugcaggccuccgggaaggucaccgugucgacgaagcgcucccagcagaccgugauccccaacgucgggagccggcccugggugcgcggccucucgucccgggugucgaucuacuggaccaucgucaagcccggcgacauccuggugaucaacuccaacgggaaccugaucgcgccgcgcggcuacuucaagaugcggaccggcaagagcuccaucaugcgcucggacgcccccaucgggacgugcuccagcgagugcaucacccccaacggguccauccccaacgacaagccguuccagaacgugaacaagaucaccuacggcgccugccccaaguacgucaagcagaacacccucaagcuggccacgggcaugcggaacgugcccgagaagcagacccgcgggaucuucggcgccaucgcgggguucaucgagaacggcugggaggggaugaucgacggcugguacggcuuccggcaccagaacucggaggggaccggccaggccgccgaccugaaguccacccaggccgccaucgaccagaucaacgggaagcucaaccgcgugaucgagaagacgaacgagaaguuccaccagaucgagaaggaguucucggaggucgagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuaccacaagugcgacaacgccugcaucggcuccauccggaacgggaccuacgaccacgacguguaccgcgacgaggcccucaacaaccgcuuccagaucaagggcguggagcucaagucgggguacaaggacuggauccuguggaucuccuucgcgaucagcugcuuccugcugugcgucgugcugcucggcuucaucaugugggccugccagaagggcaacauccggugcaacaucugcaucuga

SEQ ID NO: 746 - RNA, 1701 nt, Artificial Sequence
  derived and/or modified CDS sequence (AUadapt) from InfluenzaA__ABC02288__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaacaacgagucguucaacuggaccgggguggcccagaacggcaccuccuacgccugcaagcgccggucgaucaaguccuucuucagccgccugaacuggcuccaccagcugaaguacaaguaccccgcgcugaacgugaccaugcccaacaacgacaaguucgacaagcucuacaucuggggcguccaccaccccuccacggacucggaccagaccucccuguacgcccaggccagcgggcgggugaccgugucgaccaagcgcucccagcagacggucaucccgaacaucgggagccggcccugggugcgcggcguguccucgcggaucuccaucuacuggaccaucgucaagcccggcgacauccugcucaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccgggcacaaggacuggauccuguggaucucguucgccaucagcugcuuccuccugugcgugguccugcucggcuucaucaugugggccugccagaagggcaacauccggugcaacaucugcaucuga

SEQ ID NO: 747 - RNA, 1701 nt, Artificial Sequence; identical to SEQ ID NO: 715
  derived and/or modified CDS sequence (AUadapt) from InfluenzaA__ABC02299__HA

SEQ ID NO: 748 - RNA, 1701 nt, Artificial Sequence; identical to SEQ ID NO: 739
  derived and/or modified CDS sequence (AUadapt) from InfluenzaA__ABC02310__HA

SEQ ID NO: 749 - RNA, 1701 nt, Artificial Sequence; identical to SEQ ID NO: 744
  derived and/or modified CDS sequence (AUadapt) from InfluenzaA__ABC02321__HA

SEQ ID NO: 750 - RNA, 1701 nt, Artificial Sequence; identical to SEQ ID NO: 550
  derived and/or modified CDS sequence (AUadapt) from InfluenzaA__ABC02332__HA

SEQ ID NO: 751 - RNA, 1701 nt, Artificial Sequence
  derived and/or modified CDS sequence (AUadapt) from InfluenzaA__ABC39805__HA
augaagaccaucaucgcccugucguacauccucugccugguguucgcccagaaccugcccggcaacgacaacuccaccgcgacgcucugccuggggcaccacgccgucccgaacggcacccuggugaagaccaucaccaacgaccagaucgaggugacgaacgccaccgagcucguccagagcuccucggccgggcgcaucugcgacagcccccaccggauccuggacggcaagaacugcacccugaucgacgcccuccugggggacccccacugcgacggcuuccagaacgagaagugggaccuguucguggagcgcucgaaggcguucuccaacugcuaccccuacgacgugcaggacuacgccagccuccggucccuggucgccucguccggcacccuggaguucaucaacgagggguucaacuggacgggcgugacccagagcgggggcuccuacgccugcaagcgcgggucgggcaacuccuucuucagccggcucaacuggcuguacaaguccgagucgaaguacccggcgcugaacgugaccaugcccaacaacggcaacuucgacaagcucuacaucuggggcguccaccaccccuccaccgacaaggagcagacgaaccuguacgugcgcgccagcggccgggugaccgucucgaccaagcgcucccagcagaccgugauccccaacaucgggccgcggcccugggugcgcggccugagcucccggaucucgaucuacuggacgaucgucaagcccggcgacauccuccugaucaacuccagcgggaaccugaucgcgccccgcggcuacuucaagauccggaccgggaaguccucgaucaugcgcuccgacgccccgaucgggaccugcagcuccgagugcaucacccccaacgggucgauccccaacgacaagcccuuccagaacgugaacaagaucacguacggcgccugcccgaaguacgugaagcagaacacccucaagcuggccaccggcaugcggaacauccccgagaagcagacccgcgggaucuucggcgccaucgccggguucaucgagaacggcugggaggggauggucgacggcugguacggcuuccggcaccagaacuccgaggggacgggccaggccgccgaccugaaguccacccaggcggccaucgaccagaucaacgggaagcucaaccgcgugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagacccgccggcagcugcgcgagaacgccgaggacauggggaacggcugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 752 - RNA, 1698 nt, Artificial Sequence
  derived and/or modified CDS sequence (AUadapt) from InfluenzaA__ABC40522__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaaggaguccagcuggcccaaccacacggugaccggggucuccgccagcugcucccacaacggcaagagcuccuucuacaagaaccugcuguggcucaccgggaagaacggccuguaccccaaccugagcaaguccuacgccaacaacaaggagaaggaggugcucauccuguggggcgugcaccacccgcccaacaucggggaccagcgcacccuguaccacacggagaacgccuacgucucgguggugagcucccacuacagccggcgcuucacccccgagaucaccaagcggcccaagguccgcgaccaggagggccggaucaacuacuacuggacccuccuggagcccggggacacgaucaucuucgaggccaacggcaaccugaucgcgccgugguacgccuucgcccucucccgcggguucggcagcggcaucaucaccuccaacgcccccauggacgagugcgacgccaagugccagacgccccagggggcgaucaacagcucccugcccuuccagaacgugcacccggugaccaucggcgagugccccaaguacguccggucggccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgcgagaagaucgacggcgucaagcuggacuccaugggcguguaccagauccuggcgaucuacagcaccguggccagcucccucguccugcuggugagccucggggccaucuccuucuggaugugcagcaacggcucccugcagugccggaucugcaucuga

SEQ ID NO: 753 - RNA, 1698 nt, Artificial Sequence; identical to SEQ ID NO: 541
  derived and/or modified CDS sequence (AUadapt) from InfluenzaA__ABC40533__HA

SEQ ID NO: 754 - RNA, 1701 nt, Artificial Sequence
  derived and/or modified CDS sequence (AUadapt) from InfluenzaA__ABC40555__HA
augaagaccaucaucgcccugucguacaucuucugccucguguucgcccagaaccugccccgcaacgacaaguccaccgcgacgcugugccucggccaccacgccgucccgaacgggacccuggugaagaccaucaccaacgaccagaucgaggugacgaacgccaccgagcugguccagagcuccucgaccggccggaucugcgacagcccccaccgcauccucgacgggaagaacugcacccugguggacgcccugcucggcgacccccacugcgacggguuccagaacgagaagugggaccuguucguggagcgguccaaggccuucuccaacugcuaccccuacgacgucccggacuacgcgagccugcgcucccucguggccucguccggcacgcuggaguucaucaacgagagcuucaacuggaccggcgugacccaguccgggggcagcuacgccugcaagcggggguccgacaacucguucuucucccgccugaacuggcucuacgagagcgaguccaaguaccccguccugaacgugaccaugcccaacaacggcaacuucgacaagcuguacaucuggggcgugcaccaccccagcacggacaaggagcagaccaaccucuacguccgggccucggggcgcgugaccguguccaccaagcggagccagcagacgaucaucccgaacaucggcucccgccccuggguccgggggcugagcucccgcaucucgaucuacuggaccaucgugaagcccggcgacauccugcucaucaacuccaacgggaaccugaucgcgccccggggcuacuucaagauccgcaccggcaagagcuccaucaugcggagcgacgccccgaucgggaccugcuccucggagugcaucacgcccaacggcuccauccccaacgacaagcccuuccagaacgugaacaagaucaccuacggggccugcccgaaguacgucaagcagaacacccugaagcucgccaccggcaugcgcaacgugcccgagaagcagacgcgggggaucuucggcgccaucgcgggcuucaucgagaacgggugggagggcaugguggacgggugguacggcuuccgccaccagaacagcgaggggaccggccaggccgccgaccugaaguccacccaggccgccaucgaccagaucaacggcaagcugaaccgggucaucgagaagaccaacgagaaguuccaccagaucgagaaggaguucagcgagguggaggggcgcauccaggaccucgagaaguacguggaggacacgaagaucgaccugugguccuacaacgcggagcugcucgucgcccuggagaaccagcacaccaucgaccugaccgacucggagaugaacaagcuguucgagaagacccggcgccagcuccgcgagaacgccgaggacaugggcaacgggugcuucaagaucuaccacaagugcgacaacgccugcaucggcuccauccggaacgggacguacgaccacgacguguaccgcgacgaggcccugaacaaccgguuccagaucaagggcgucgagcucaagagcggcuacaaggacuggauccuguggaucagcuucgcgaucuccugcuuccugcucugcguggugcugcugggguucaucaugugggccugccagaagggcaacauccgcugcaacaucugcaucuga

SEQ ID NO: 755 - RNA, 1701 nt, Artificial Sequence
  derived and/or modified CDS sequence (AUadapt) from InfluenzaA__ABC40608__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcgagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccucggccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccucgacggacuccgaccagaccagccuguacgcccaggccucggggcgggugaccguguccacccgccggagccagcagacggucaucccgaacaucgggucccgccccugggugcggggcgugucgucccgcaucagcaucuacuggaccaucgucaagcccggcgacauccuccugaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagagcgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacuccgaggggacgggccaggccgcggaccugaaguccacccaggccgccaucaaccagaucaacgggaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacacgaucgaccugaccgacuccgagaugaacaagcuguucgagcgcacccggaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcucaagucgggguacaaggacuggauccuguggaucuccuucgccaucagcugcuuccugcugugcgugguccuccugggcuucaucaugugggccugccagaagggcaacauccgcugcaacaucugcaucuga

SEQ ID NO: 756 - RNA, 1701 nt, Artificial Sequence
  derived and/or modified CDS sequence (AUadapt) from InfluenzaA__ABC40619__HA
augaagaccaucaucgcccugucguacaucuucugccucgugcugggccaggacuucuccgggaacgacaacagcaccgccacgcugugccucggccaccacgcgguccccaacgggacccuggugaagaccaucaccaacgaccagaucgaggugacgaacgccaccgagcugguccaguccucguccaccggcaagaucugcaacaacccgcaccgcauccucgacgggaucgacugcacccugaucgacgcccugcucggcgacccccacugcgacggcuuccagaacgagacgugggaccuguucguggagcggagcaaggccuucuccaacugcuaccccuacgacgugcccgacuacgccagccugcgcucccucgucgcgucguccgggacccuggaguucaucaacgagggcuucaacuggaccggggugacccagaacggcgggagcaacgccugcaagcggggcccggacuccggcuucuucucgcgccugaacuggcucuacaaguccgggagcacguaccccgugcugaacgucuccaugcccaacaacgacaacuucgacaagcuguacaucuggggcgugcaccaccccagcaccgaccaggagcagaccaaccucuacgugcaggccuccgggcgggucaccgugucgacgaagcgcagccagcagaccaucaucccgaacaucggcucccggcccugggugcgcggccugagcucccggaucucgaucuacuggaccaucgucaagcccggggacauccuggugaucaacuccaacggcaaccucaucgcgccccgcggguacuucaagaugcggaccggcaagagcuccaucaugcgcucggacgccccgaucgggacgugcaucuccgagugcaucacccccaacggcagcauccccaacgacaagcccuuccagaacgugaacaagaucaccuacggcgccugcccgaaguacgucaagcagaacacccugaagcuggccacggggaugcggaacgugcccgagaagcagacccgcggcaucuucggggccaucgccggcuucaucgagaacgggugggagggcaugaucgacggcugguacggguuccggcaccagaacuccgagggcaccgggcaggcggccgaccucaagagcacccaggccgccaucgaccagaucaacggcaagcugaaccgcaucaucgagaagacgaacgagaaguuccaccagaucgagaaggaguucuccgagguggaggggcggauccaggaccuggagaaguacgucgaggacaccaagaucgaccucuggucguacaacgccgagcugcugguggcgcucgagaaccagcacaccaucgaccugaccgacuccgagaugaacaagcuguucgagaagacgcgccggcagcuccgcgagaacgccgaggacaugggcaacggcugcuucaagaucuaccacaagugcgacaacgccugcaucgggagcauccggaacggcaccuacgaccacgacguguaccgcgacgaggcccugaacaaccgcuuccagaucaagggggucgagcugaaguccggcuacaaggacuggauccucuggaucagcuucgccaucuccugcuuccugcugugcgugguccuccugggcuucaucaugugggcgugccagaaggggaacauccggugcaacaucugcaucuga

SEQ ID NO: 757 - RNA, 1698 nt, Artificial Sequence
  derived and/or modified CDS sequence (AUadapt) from InfluenzaA__ABC40631__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacgcuguaccacaccgagaacgccuacgucucgguggugagcucccacuacagccgccgguucacccccgagaucaccaagcgccccaagguccgggaccaggagggccgcaucaacuacuacuggacgcuccuggagcccggggacaccaucaucuucgaggccaacggcaaccugaucgccccgugguacgcguucgcccucucccggggguucggcagcggcaucaucaccuccaacgcccccauggacgagugcgacgccaagugccagacgccccagggggccaucaacagcucccugcccuuccagaacgugcacccggugaccaucggcgagugccccaaguacguccgcucggcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgucaagcuggaguccaugggcguguaccagauccuggccaucuacagcaccguggcgagcucccucguccugcuggugagccucggggccaucuccuucuggaugugcagcaacggcucccugcagugccgcaucugcaucuga

SEQ ID NO: 758 - RNA, 1701 nt, Artificial Sequence
  derived and/or modified CDS sequence (AUadapt) from InfluenzaA__ABC41692__HA
augaagaccaucaucgcccugucguacauccucugccugguguucgcccagaagcccccgggcaacgacaacuccaccgcgacgcugugccucgggcaccacgccguccccaacggcaccaucgugaagaccaucaccaacgaccagaucgaggugacgaacgccaccgagcugguccagucguccucgaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuacccguacgacgugcccgaccacgcgucgcugcggucccuggucgccucguccgggacgcucgaguucaacaacgagucguucgacuggaccggcgugacccagaacgggaccuccagcgccugcaagcgccgguccaacaagucguucuucucccgccugaacuggcugacgcaccucaaguacaaguaccccgcccugaacgugaccaugcccaacaacgagaaguucgacaagcuguacaucuggggcguccaccacccggggaccgacucggaccagaucucccucuacgcgcaggccucgggccggaucaccgugagcacgaagcgcucccagcagaccgugauccccaacaucggcucgcggccccgcguccgggacguguccucgcgcaucuccaucuacuggaccaucgugaagcccggggacauccugcugaucaacucgaccggcaaccucaucgccccgcggggguacuucaagauccgcuccggcaagagcuccaucaugcggucggacgcccccaucggcaagugcaacuccgagugcaucacgcccaacgggucgauccccaacgacaagccguuccagaacgucaaccgcaucaccuacggcgccugcccccgguacgugaagcagaacacccugaagcuggcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagucgacccaggcggccaucaaccagaucaacggcaagcugaaccggcugaucggcaagaccaacgagaaguuccaccagaucgagaaggaguucuccgagguggaggggcgcauccaggaccucgagaaguacguggaggacacgaagaucgaccuguggagcuacaacgccgagcugcucgucgcccuggagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcguggagcucaaguccggcuacaaggacuggauccuguggaucucguucgccaucagcugcuuccugcucugcgucgcccugcugggguucaucaugugggccugccagaagggcaacauccggugcaacaucugcaucuga

SEQ ID NO: 759 - RNA, 1698 nt, Artificial Sequence; identical to SEQ ID NO: 544
  derived and/or modified CDS sequence (AUadapt) from InfluenzaA__ABC41714__HA

SEQ ID NO: 760 - RNA, 1701 nt, Artificial Sequence
  derived and/or modified CDS sequence (AUadapt) from InfluenzaA__ABC41725__HA
augaagaccaccaucgcccugucguacauccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccucgaccgggggcaucugcgacagcccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccucguccgggacccuggaguucaacaacgagagcuucgacuggaccggcgugacccagaacgggacguccucggccugcaagcgccgguccaacaagucguucuucucccgccugaacuggcucacccaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucacggugucgaccaagcgcucccagcagaccgugaucccgaacaucggcucgcggccccgcguccgggacguguccucgcgcaucuccaucuacuggaccaucgugaagcccggggacauccugcucaucaacagcacgggcaaccugaucgcgccccggggguacuucaagauccgcuccggcaagucguccaucaugcggucggacgccccgaucggcaagugcaacuccgagugcaucacccccaacgggucgauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 761 - RNA, 1701 nt, Artificial Sequence
  derived and/or modified CDS sequence (AUadapt) from InfluenzaA__ABC41736__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 762 - RNA, 1701 nt, Artificial Sequence; identical to SEQ ID NO: 761
  derived and/or modified CDS sequence (AUadapt) from InfluenzaA__ABC41952__HA

SEQ ID NO: 763 - RNA, 1701 nt, Artificial Sequence; identical to SEQ ID NO: 761
  derived and/or modified CDS sequence (AUadapt) from InfluenzaA__ABC41953__HA

SEQ ID NO: 764 - RNA, 1701 nt, Artificial Sequence; identical to SEQ ID NO: 761
  derived and/or modified CDS sequence (AUadapt) from InfluenzaA__ABC41964__HA

SEQ ID NO: 765 - RNA, 1701 nt, Artificial Sequence; identical to SEQ ID NO: 761
  derived and/or modified CDS sequence (AUadapt) from InfluenzaA__ABC42014__HA

SEQ ID NO: 766 - RNA, 1701 nt, Artificial Sequence; identical to SEQ ID NO: 761
  derived and/or modified CDS sequence (AUadapt) from InfluenzaA__ABC42114__HA

SEQ ID NO: 767 - RNA, 1701 nt, Artificial Sequence; identical to SEQ ID NO: 761
  derived and/or modified CDS sequence (AUadapt) from InfluenzaA__ABC42125__HA

SEQ ID NO: 768 - RNA, 1701 nt, Artificial Sequence; identical to SEQ ID NO: 761
  derived and/or modified CDS sequence (AUadapt) from InfluenzaA__ABC42136__HA

SEQ ID NO: 769 - RNA, 1701 nt, Artificial Sequence
  derived and/or modified CDS sequence (AUadapt) from InfluenzaA__ABC42147__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgucccgaucggcaagugcaacuccgagugcaucacgcccaacgggucgauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 770 - RNA, 1701 nt, Artificial Sequence; identical to SEQ ID NO: 761
  derived and/or modified CDS sequence (AUadapt) from InfluenzaA__ABC42158__HA

SEQ ID NO: 771 - RNA, 1701 nt, Artificial Sequence; identical to SEQ ID NO: 761
  derived and/or modified CDS sequence (AUadapt) from InfluenzaA__ABC42169__HA

SEQ ID NO: 772 - RNA, 1701 nt, Artificial Sequence; identical to SEQ ID NO: 761
  derived and/or modified CDS sequence (AUadapt) from InfluenzaA__ABC42180__HA

SEQ ID NO: 773 - RNA, 1701 nt, Artificial Sequence; identical to SEQ ID NO: 761
  derived and/or modified CDS sequence (AUadapt) from InfluenzaA__ABC42192__HA

SEQ ID NO: 774 - RNA, 1701 nt, Artificial Sequence; identical to SEQ ID NO: 761
  derived and/or modified CDS sequence (AUadapt) from InfluenzaA__ABC42307__HA

SEQ ID NO: 775 - RNA, 1701 nt, Artificial Sequence
  derived and/or modified CDS sequence (AUadapt) from InfluenzaA__ABC42318__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugagcacgaagcgcucccagcagaccgugaucccgaacaucggcucgcggccccgcguccgggacguguccucgcgcaucuccaucuacuggaccaucgugaagcccggggacauccugcucaucaacagcaccggcaaccugaucgcgccccggggguacuucaagauccgcuccggcaagucguccaucaugcggucggacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagucgacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgaguuccucgucgcccuggagaaccagcacaccaucgaccugaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcguggagcucaaguccggcuacaaggacuggauccuguggaucucguucgccaucagcugcuuccugcucugcgucgcccugcugggguucaucaugugggccugccagaagggcaacauccggugcaacaucugcaucuga

SEQ ID NO: 776 - RNA, 1701 nt, Artificial Sequence; identical to SEQ ID NO: 761
  derived and/or modified CDS sequence (AUadapt) from InfluenzaA__ABC42346__HA

SEQ ID NO: 777 - RNA, 1701 nt, Artificial Sequence; identical to SEQ ID NO: 761
  derived and/or modified CDS sequence (AUadapt) from InfluenzaA__ABC42461__HA

SEQ ID NO: 778 - RNA, 1701 nt, Artificial Sequence; identical to SEQ ID NO: 761
  derived and/or modified CDS sequence (AUadapt) from InfluenzaA__ABC42494__HA

SEQ ID NO: 779 - RNA, 1701 nt, Artificial Sequence; identical to SEQ ID NO: 761
  derived and/or modified CDS sequence (AUadapt) from InfluenzaA__ABC42505__HA

SEQ ID NO: 780 - RNA, 1701 nt, Artificial Sequence
  derived and/or modified CDS sequence (AUadapt) from InfluenzaA__ABC42516__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaacaagcucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggacguacgaccacgacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggccugccagaagggcaacauccgcugcaacaucugcaucuga

SEQ ID NO: 781 - RNA, 1701 nt, Artificial Sequence; identical to SEQ ID NO: 761
  derived and/or modified CDS sequence (AUadapt) from InfluenzaA__ABC42527__HA

SEQ ID NO: 782 - RNA, 1701 nt, Artificial Sequence; identical to SEQ ID NO: 761
  derived and/or modified CDS sequence (AUadapt) from InfluenzaA__ABC42574__HA

SEQ ID NO: 783 - RNA, 1701 nt, Artificial Sequence; identical to SEQ ID NO: 761
  derived and/or modified CDS sequence (AUadapt) from InfluenzaA__ABC42585__HA

SEQ ID NO: 784 - RNA, 1701 nt, Artificial Sequence; identical to SEQ ID NO: 488
  derived and/or modified CDS sequence (AUadapt) from InfluenzaA__ABC42596__HA

SEQ ID NO: 785 - RNA, 1701 nt, Artificial Sequence; identical to SEQ ID NO: 527
  derived and/or modified CDS sequence (AUadapt) from InfluenzaA__ABC42607__HA

SEQ ID NO: 786 - RNA, 1701 nt, Artificial Sequence; identical to SEQ ID NO: 527
  derived and/or modified CDS sequence (AUadapt) from InfluenzaA__ABC42618__HA

SEQ ID NO: 787 - RNA, 1701 nt, Artificial Sequence
  derived and/or modified CDS sequence (AUadapt) from InfluenzaA__ABC42629__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 788 - RNA, 1701 nt, Artificial Sequence
  derived and/or modified CDS sequence (AUadapt) from InfluenzaA__ABC42640__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccuggucgccagcuccgggacgcucgaguucaacaacgagucguucaacuggaccggcgugacccagaacgggaccuccagcgccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaucucgcucuacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcugaucaacagcaccggcaaccucaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagucgacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 789 - RNA, 1701 nt, Artificial Sequence; identical to SEQ ID NO: 488
  derived and/or modified CDS sequence (AUadapt) from InfluenzaA__ABC42651__HA

SEQ ID NO: 790 - RNA, 1701 nt, Artificial Sequence
  derived and/or modified CDS sequence (AUadapt) from InfluenzaA__ABC42662__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcagccagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagucgacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgaguuccucguggcccuggagaaccagcacacgaucgaccugaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 791 - RNA, 1701 nt, Artificial Sequence
  derived and/or modified CDS sequence (AUadapt) from InfluenzaA__ABC42673__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagucguccagcaccgggggcaucugcgacucgccccaccagauccucgacggggagaacugcacccugaucgacgcccugcucggcgacccccagugcgacggcuuccagaacaagaagugggaccuguucgucgagcgcucgaaggccuacuccaacugcuaccccuacgacgugccggacuacgcgagccugcggucccucguggccucguccgggacgcuggaguucaacaacgagagcuucaacuggaccggcgucacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucucgacgaagcgcucgcagcagaccgugaucccgaacaucggcucccggccccgcgugcgggacauccccagccgcaucuccaucuacuggaccaucgucaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 792 - RNA, 1701 nt, Artificial Sequence; identical to SEQ ID NO: 488
  derived and/or modified CDS sequence (AUadapt) from InfluenzaA__ABC42684__HA

SEQ ID NO: 793 - RNA, 1701 nt, Artificial Sequence; identical to SEQ ID NO: 488
  derived and/or modified CDS sequence (AUadapt) from InfluenzaA__ABC42695__HA

SEQ ID NO: 794 - RNA, 1701 nt, Artificial Sequence
  derived and/or modified CDS sequence (AUadapt) from InfluenzaA__ABC42706__HA
augaagaccaucaucgcccugucguacauccucugccugguguucgcccagaagcugcccggcaacgacaacuccaccgcgacgcucugccuggggcaccacgccgucccgaacggcaccaccgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacccuggaguucaacaacgagagcuucaacuggaccggcgugacccagaacgggacguccucggccugcaagcgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucacggugucgaccaagcgcucgcagcagaccgugaucccgaacaucggcucccggccccgcguccgggacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaacuccgagugcaucacccccaacgggucgauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 795 - RNA, 1701 nt, Artificial Sequence; identical to SEQ ID NO: 488
  derived and/or modified CDS sequence (AUadapt) from InfluenzaA__ABC42717__HA

SEQ ID NO: 796 - RNA, 1701 nt, Artificial Sequence
  derived and/or modified CDS sequence (AUadapt) from InfluenzaA__ABC42728__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccgggggcaucugcgacucgccccaccagauccucgacggggagaacugcacccugauggacgcccugcucggcgacccccagugcgacggcuuccagaacaagaagugggaccuguucguggagcgcucgcgggccuacuccaacugcuaccccuacgacgucccggacuacgcgagccugcgcucccucguggccucguccgggacgcuggaguucaacaacgagagcuucaacuggaccggcgugacccagaacgggaccuccucggccugcaagcggcgcuccaacaacucguucuucucccggcugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcgcaggccuccggccgcaucaccgugucgacgaagcggucgcagcagaccgucaucccgaacaucggcucccgcccccgggugcgcgacauccccagccggaucuccaucuacuggaccaucgugaagcccggggacauccugcucaucaacucgaccggcaaccugaucgccccgcgcggguacuucaagauccgguccggcaagagcuccaucaugcgcucggacgcccccaucggcaagugcaacuccgagugcaucacgcccaacgggucgauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcucgauccggaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgugcugcucggguucaucaugugggccugccagaagggcaacauccgcugcaacaucugcaucuga

SEQ ID NO: 797 - RNA, 1701 nt, Artificial Sequence; identical to SEQ ID NO: 488
  derived and/or modified CDS sequence (AUadapt) from InfluenzaA__ABC42739__HA

SEQ ID NO: 798 - RNA, 1698 nt, Artificial Sequence
  derived and/or modified CDS sequence (AUadapt) from InfluenzaA__ABC42750__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 799 - RNA, 1701 nt, Artificial Sequence; identical to SEQ ID NO: 488
  derived and/or modified CDS sequence (AUadapt) from InfluenzaA__ABC42761__HA

SEQ ID NO: 800 - RNA, 1701 nt, Artificial Sequence
  derived and/or modified CDS sequence (AUadapt) from InfluenzaA__ABC42772__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagagcuucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugucgacgaagcgcagccagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaaguccguggagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 801 - RNA, 1701 nt, Artificial Sequence; identical to SEQ ID NO: 488
  derived and/or modified CDS sequence (AUadapt) from InfluenzaA__ABC42783__HA

SEQ ID NO: 802 - RNA, 1701 nt, Artificial Sequence; identical to SEQ ID NO: 488
  derived and/or modified CDS sequence (AUadapt) from InfluenzaA__ABC42794__HA

SEQ ID NO: 803 - RNA, 1701 nt, Artificial Sequence; identical to SEQ ID NO: 488
  derived and/or modified CDS sequence (AUadapt) from InfluenzaA__ABC42805__HA

SEQ ID NO: 804 - RNA, 1701 nt, Artificial Sequence; identical to SEQ ID NO: 527
  derived and/or modified CDS sequence (AUadapt) from InfluenzaA__ABC42816__HA

SEQ ID NO: 805 - RNA, 1701 nt, Artificial Sequence
  derived and/or modified CDS sequence (AUadapt) from InfluenzaA__ABC42827__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcauguccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 806 - RNA, 1701 nt, Artificial Sequence; identical to SEQ ID NO: 488
  derived and/or modified CDS sequence (AUadapt) from InfluenzaA__ABC42849__HA

SEQ ID NO: 807 - RNA, 1701 nt, Artificial Sequence
  derived and/or modified CDS sequence (AUadapt) from InfluenzaA__ABC42882__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucucguucgccaucagcugcuuccugcugugcaucguccuccugggcuucaucaugugggccugccagaaggggaacauccggugcaacaucugcaucuga

SEQ ID NO: 808 - RNA, 1701 nt, Artificial Sequence; identical to SEQ ID NO: 807
  derived and/or modified CDS sequence (AUadapt) from InfluenzaA__ABC42893__HA

SEQ ID NO: 809 - RNA, 1701 nt, Artificial Sequence; identical to SEQ ID NO: 761
  derived and/or modified CDS sequence (AUadapt) from InfluenzaA__ABC42929__HA

SEQ ID NO: 810 - RNA, 1701 nt, Artificial Sequence; identical to SEQ ID NO: 761
  derived and/or modified CDS sequence (AUadapt) from InfluenzaA__ABC42940__HA

SEQ ID NO: 811 - RNA, 1701 nt, Artificial Sequence; identical to SEQ ID NO: 761
  derived and/or modified CDS sequence (AUadapt) from InfluenzaA__ABC42951__HA

SEQ ID NO: 812 - RNA, 1701 nt, Artificial Sequence; identical to SEQ ID NO: 761
  derived and/or modified CDS sequence (AUadapt) from InfluenzaA__ABC42962__HA

SEQ ID NO: 813 - RNA, 1701 nt, Artificial Sequence; identical to SEQ ID NO: 761
  derived and/or modified CDS sequence (AUadapt) from InfluenzaA__ABC42973__HA

SEQ ID NO: 814 - RNA, 1701 nt, Artificial Sequence; identical to SEQ ID NO: 761
  derived and/or modified CDS sequence (AUadapt) from InfluenzaA__ABC42995__HA

SEQ ID NO: 815 - RNA, 1701 nt, Artificial Sequence; identical to SEQ ID NO: 761
  derived and/or modified CDS sequence (AUadapt) from InfluenzaA__ABC43006__HA

SEQ ID NO: 816 - RNA, 1701 nt, Artificial Sequence; identical to SEQ ID NO: 761
  derived and/or modified CDS sequence (AUadapt) from InfluenzaA__ABC43028__HA

SEQ ID NO: 817 - RNA, 1701 nt, Artificial Sequence; identical to SEQ ID NO: 761
  derived and/or modified CDS sequence (AUadapt) from InfluenzaA__ABC43039__HA

SEQ ID NO: 818 - RNA, 1701 nt, Artificial Sequence; identical to SEQ ID NO: 761
  derived and/or modified CDS sequence (AUadapt) from InfluenzaA__ABC43050__HA

SEQ ID NO: 819 - RNA, 1701 nt, Artificial Sequence; identical to SEQ ID NO: 761
  derived and/or modified CDS sequence (AUadapt) from InfluenzaA__ABC43061__HA

SEQ ID NO: 820 - RNA, 1701 nt, Artificial Sequence
  derived and/or modified CDS sequence (AUadapt) from InfluenzaA__ABC43072__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgcgugcaucggcucgauccgcaacgggacguacgaccacgacguguaccgcgacgaggcccucaacaaccgguuccagaucaagggcguggagcugaaguccggcuacaaggacuggauccuguggaucucguucaccaucagcugcuuccuccugugcgucgcccugcucggguucaucaugugggccugccagaagggcaacauccgcugcaacaucugcaucuga

SEQ ID NO: 821 - RNA, 1701 nt, Artificial Sequence; identical to SEQ ID NO: 761
  derived and/or modified CDS sequence (AUadapt) from InfluenzaA__ABC43083__HA

SEQ ID NO: 822 - RNA, 1701 nt, Artificial Sequence; identical to SEQ ID NO: 761
  derived and/or modified CDS sequence (AUadapt) from InfluenzaA__ABC43094__HA

SEQ ID NO: 823 - RNA, 1701 nt, Artificial Sequence; identical to SEQ ID NO: 761
  derived and/or modified CDS sequence (AUadapt) from InfluenzaA__ABC43116__HA

SEQ ID NO: 824 - RNA, 1701 nt, Artificial Sequence; identical to SEQ ID NO: 488
  derived and/or modified CDS sequence (AUadapt) from InfluenzaA__ABC43127__HA

SEQ ID NO: 825 - RNA, 1701 nt, Artificial Sequence; identical to SEQ ID NO: 527
  derived and/or modified CDS sequence (AUadapt) from InfluenzaA__ABC43138__HA

SEQ ID NO: 826 - RNA, 1701 nt, Artificial Sequence; identical to SEQ ID NO: 488
  derived and/or modified CDS sequence (AUadapt) from InfluenzaA__ABC43149__HA

SEQ ID NO: 827 - RNA, 1701 nt, Artificial Sequence; identical to SEQ ID NO: 488
  derived and/or modified CDS sequence (AUadapt) from InfluenzaA__ABC43160__HA

SEQ ID NO: 828 - RNA, 1701 nt, Artificial Sequence; identical to SEQ ID NO: 488
  derived and/or modified CDS sequence (AUadapt) from InfluenzaA__ABC43171__HA

SEQ ID NO: 829 - RNA, 1701 nt, Artificial Sequence; identical to SEQ ID NO: 488
  derived and/or modified CDS sequence (AUadapt) from InfluenzaA__ABC43182__HA

SEQ ID NO: 830 - RNA, 1701 nt, Artificial Sequence
  derived and/or modified CDS sequence (AUadapt) from InfluenzaA__ABC43475__HA
augaagaccaucaucgcccugucguacauccucugccugguguucgcccagaagcugcccggcaacgacaacuccaccgcgacgcucugccuggggcaccacgccgucccgaacggcaccaccgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacccuggaguucaacaacgagucguucaacuggaccggcgugacccagaacgggacguccagcgccugcaagcgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucacggugagcaccaagcgcucgcagcagaccgugaucccgaacaucggcucccggccccgcguccgggacauccccucgcgcaucuccaucuacuggaccaucgugaagcccggggacauccugcucaucaacagcacgggcaaccugaucgccccgcggggguacuucaagauccgcuccggcaagucguccaucaugcggucggacgcccccaucggcaagugcaacuccgagugcaucacccccaacgggagcauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 831 - RNA, 1701 nt, Artificial Sequence; identical to SEQ ID NO: 488
  derived and/or modified CDS sequence (AUadapt) from InfluenzaA__ABC43486__HA

SEQ ID NO: 832 - RNA, 1701 nt, Artificial Sequence; identical to SEQ ID NO: 488
  derived and/or modified CDS sequence (AUadapt) from InfluenzaA__ABC43497__HA

SEQ ID NO: 833 - RNA, 1701 nt, Artificial Sequence; identical to SEQ ID NO: 527
  derived and/or modified CDS sequence (AUadapt) from InfluenzaA__ABC43508__HA

SEQ ID NO: 834 - RNA, 1701 nt, Artificial Sequence; identical to SEQ ID NO: 527
  derived and/or modified CDS sequence (AUadapt) from InfluenzaA__ABC43519__HA

SEQ ID NO: 835 - RNA, 1701 nt, Artificial Sequence; identical to SEQ ID NO: 527
  derived and/or modified CDS sequence (AUadapt) from InfluenzaA__ABC43530__HA

SEQ ID NO: 836 - RNA, 1701 nt, Artificial Sequence
  derived and/or modified CDS sequence (AUadapt) from InfluenzaA__ABC43552__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccccgggccggaucaccguguccacgaagcgcagccagcagaccgugauccccaacaucggcucgcggccccgcguccgggacauccccucccgcaucucgaucuacuggaccaucgugaagccgggggacauccugcucaucaacuccaccggcaaccugaucgcgccccggggguacuucaagauccgcagcggcaaguccucgaucaugcgguccgacgcccccaucggcaagugcaacucggagugcaucacgcccaacggguccaucccgaacgacaagcccuuccagaacgugaaccgcaucaccuacggcgccugcccccgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 837 - RNA, 1701 nt, Artificial Sequence
  derived and/or modified CDS sequence (AUadapt) from InfluenzaA__ABC46554__HA
augaagaccaucaucgcccugucguacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccucgaccgggcgcaucugcgacagcccccaccggauccuggacggcaagaacugcacccucaucgacgcccugcugggggacccccacugcgacggcuuccagaacgagaagugggaccucuucguggagcgcuccaaggccuucuccaacugcuaccccuacgacgugccggacuacgcgucgcugcggucccuggucgccagcuccggcacgcucgaguucaucaacgagggguucaacuggaccggcgugacccaggacgggggcucguacgccugcaagcgcgggcccgacaacuccuucuucagccggcugaacuggcuguacaaguccgagucgaccuaccccgugcucaacgucacgaugcccaacaacgacaacuucgacaagcuguacaucuggggcgugcaccacccguccaccgacaaggagcagaccaaccuguacgugcaggccagcggccgcgucaccguguccacgaagcggucgcagcagaccaucauccccaacguggggagccgccccuggguccggggccucuccucgcgcaucuccaucuacuggaccaucgugaagcccggggacauccugcugaucaacagcaacggcaaccucaucgcgccgcggggcuacuucaagauccgcaccgggaaguccucgaucaugcgguccgacgcccccaucggcacgugcagcuccgagugcaucacccccaacgggucgauccccaacgacaagccguuccagaacgugaacaagaucaccuacggcgccugccccaaguacgucaagcagaacacccugaagcuggccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagagcacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccucuggucguacaacgcggagcugcugguggcccucgagaaccagcacaccaucgaccugaccgacuccgagaugaacaagcuguucgagaagacgcggcgccagcuccgggagaacgccgaggacauggggaacggcugcuucaagaucuaccacaagugcgacaacgccugcaucgggagcauccgcaacggcaccuacgaccacgacgucuaccgcgacgaggcccugaacaaccgguuccagaucaagggcguggagcugaaguccggguacaaggacuggauccucuggaucagcuucgcgaucuccugcuuccugcugugcgucgugcuccugggcuucaucaugugggccugccagaaggggaacauccgcugcaacaucugcaucuga

SEQ ID NO: 838 - RNA, 1701 nt, Artificial Sequence
  derived and/or modified CDS sequence (AUadapt) from InfluenzaA__ABC46576__HA
augaagaccaucaucgcccugucguacaucuucugccucguguucgcccagaaccugcccggcaacgacaaguccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccucguccggcacgcuggaguucaucaacgagagcuucaacuggaccggggugacccaguccggcgggagcuacgccugcaagcgcggcuccgacaacucguucuucucccggcugaacuggcucuacgagagcgaguccaaguaccccguccugaacgugaccaugcccaacaacgggaacuucgacaagcuguacaucuggggcgugcaccaccccagcacggacaaggagcagaccaaccucuacguccgcgccucgggccgggugaccguguccaccaagcgcagccagcagacgaucaucccgaacaucgggucccggcccuggguccgcggccugagcucccggaucucgaucuacuggaccaucgugaagcccggggacauccugcucaucaacuccaacggcaaccugaucgcgccccgcggcuacuucaagauccggaccggcaagagcuccaucaugcgcagcgacgccccgaucgggaccugcuccucggagugcaucacgcccaacggguccauccccaacgacaagcccuuccagaacgugaacaagaucaccuacggcgccugcccgaaguacgucaagcagaacacccugaagcucgccaccgggaugcggaacgugcccgagaagcagacgcgcggcaucuucggcgccaucgcgggguucaucgagaacggcugggaggggaugguggacggcugguacggguuccggcaccagaacagcgagggcaccggccaggccgccgaccugaaguccacccaggccgccaucgaccagaucaacgggaagcugaaccgcgucaucgagaagaccaacgagaaguuccaccagaucgagaaggaguucagcgagguggagggccggauccaggaccucgagaaguacguggaggacacgaagaucgaccugugguccuacaacgcggagcugcucgucgcccuggagaaccagcacaccaucgaccugaccgacucggagaugaacaagcuguucgagaagacccgccggcagcuccgcgagaacgccgaggacauggggaacggcugcuucaagaucuaccacaagugcgacaacgccugcaucggguccauccgcaacggcacguacgaccacgacguguaccgggacgaggcccugaacaaccgcuuccagaucaagggcgucgagcucaagagcggguacaaggacuggauccuguggaucagcuucgcgaucuccugcuuccugcucugcguggugcugcugggcuucaucaugugggccugccagaaggggaacauccggugcaacaucugcaucuga

SEQ ID NO: 839 - RNA, 1701 nt, Artificial Sequence; identical to SEQ ID NO: 697
  derived and/or modified CDS sequence (AUadapt) from InfluenzaA__ABC50167__HA

SEQ ID NO: 840 - RNA, 1701 nt, Artificial Sequence; identical to SEQ ID NO: 697
  derived and/or modified CDS sequence (AUadapt) from InfluenzaA__ABC50178__HA

SEQ ID NO: 841 - RNA, 1701 nt, Artificial Sequence; identical to SEQ ID NO: 697
  derived and/or modified CDS sequence (AUadapt) from InfluenzaA__ABC50189__HA

SEQ ID NO: 842 - RNA, 1701 nt, Artificial Sequence; identical to SEQ ID NO: 807
  derived and/or modified CDS sequence (AUadapt) from InfluenzaA__ABC50200__HA

SEQ ID NO: 843 - RNA, 1701 nt, Artificial Sequence; identical to SEQ ID NO: 807
  derived and/or modified CDS sequence (AUadapt) from InfluenzaA__ABC50211__HA

SEQ ID NO: 844 - RNA, 1701 nt, Artificial Sequence; identical to SEQ ID NO: 807
  derived and/or modified CDS sequence (AUadapt) from InfluenzaA__ABC50222__HA

SEQ ID NO: 845 - RNA, 1701 nt, Artificial Sequence; identical to SEQ ID NO: 807
  derived and/or modified CDS sequence (AUadapt) from InfluenzaA__ABC50233__HA

SEQ ID NO: 846 - RNA, 1701 nt, Artificial Sequence; identical to SEQ ID NO: 807
  derived and/or modified CDS sequence (AUadapt) from InfluenzaA__ABC50244__HA

SEQ ID NO: 847 - RNA, 1701 nt, Artificial Sequence; identical to SEQ ID NO: 807
  derived and/or modified CDS sequence (AUadapt) from InfluenzaA__ABC50266__HA

SEQ ID NO: 848 - RNA, 1701 nt, Artificial Sequence; identical to SEQ ID NO: 807
  derived and/or modified CDS sequence (AUadapt) from InfluenzaA__ABC50277__HA

SEQ ID NO: 849 - RNA, 1701 nt, Artificial Sequence
  derived and/or modified CDS sequence (AUadapt) from InfluenzaA__ABC50299__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucucguucgccaccagcugcuuccugcugugcaucguccuccugggcuucaucaugugggccugccagaaggggaacauccggugcaacaucugcaucuga

SEQ ID NO: 850 - RNA, 1701 nt, Artificial Sequence; identical to SEQ ID NO: 807
  derived and/or modified CDS sequence (AUadapt) from InfluenzaA__ABC50310__HA

SEQ ID NO: 851 - RNA, 1701 nt, Artificial Sequence
  derived and/or modified CDS sequence (AUadapt) from InfluenzaA__ABC50321__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccggcaagcagacccgggggaucuucggcgccaucgccggcuucaucgagaacgggugggagggcaugauggacgggugguacggcuuccgccaccagaacuccgaggggaccggccaggccgccgaccugaaguccacgcaggcggccaucaaccagaucaacggcaagcucaaccggcugaucgagaagaccaacgagaaguuccaccagaucgagaaggaguucuccgagguggaggggcgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacugggugcucuggaucucguucgccaucagcugcuuccugcugugcaucguccuccugggguucaucaugugggccugccagaagggcaacauccggugcaacaucugcaucuga

SEQ ID NO: 852 - RNA, 1701 nt, Artificial Sequence
  derived and/or modified CDS sequence (AUadapt) from InfluenzaA__ABC50332__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacggcaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugauggacgggugguacggcuuccgccaccagaacuccgaggggaccggccaggccgccgaccugaaguccacgcaggcggccaucaaccagaucaacggcaagcucaaccggcugaucgagaagaccaacgagaaguuccaccagaucgagaaggaguucuccgagguggaggggcgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacuggauccucuggaucucguucgccaucagcugcuuccugcugugcaucgugcuccugggguucaucaugugggccugccagaagggcaacauccggugcaacaucugcaucuga

SEQ ID NO: 853 - RNA, 1701 nt, Artificial Sequence; identical to SEQ ID NO: 807
  derived and/or modified CDS sequence (AUadapt) from InfluenzaA__ABC50343__HA

SEQ ID NO: 854 - RNA, 1701 nt, Artificial Sequence
  derived and/or modified CDS sequence (AUadapt) from InfluenzaA__ABC50354__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucguccugcaagcggcgcagcgacaaguccuucuucucgcggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcccaggcgucggggcgcgugaccgucuccaccaagcggagccagcagaccgugaucccgaacaucggcucccgccccugggugcggggcgucucgucccgcaucagcaucuacuggacgaucgugaagcccggggacauccuccugaucaacuccaccggcaaccugaucgcgccccggggguacuucaagauccgcucgggcaaguccagcaucaugcgguccgacgccccgaucggcaagugcaacucggagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggccgcgaucaaccagaucaacggcaagcucaaccggcugaucgagaagaccaacgagaaguuccaccagaucgagaaggaguucucggagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacguguaccgggacgaggcgcugaacaaccgcuuccagaucaagggggucgagcugaaguccggcuacaaggacugggugcucuggaucagcuucgccaucuccugcuuccugcugugcaucguccuccugggcuucaucaugugggccugccagaaggggaacauccggugcaacaucugcaucuga

SEQ ID NO: 855 - RNA, 1701 nt, Artificial Sequence
  derived and/or modified CDS sequence (AUadapt) from InfluenzaA__ABC50376__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacacgggcagccgccccugggugcggggcgucuccucgcgcaucuccaucuacuggaccaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugauggacggcugguacggguuccgccaccagaacuccgagggcacggggcaggccgccgaccugaaguccacccaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacacgaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucucguucgccaucagcugcuuccugcugugcaucguccuccugggcuucaucaugugggccugccagaaggggaacauccggugcaacaucugcaucuga

SEQ ID NO: 856 - RNA, 1701 nt, Artificial Sequence
  derived and/or modified CDS sequence (AUadapt) from InfluenzaA__ABC50387__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacguguggggcgugcaccaccccgggacggacagcgaccagaucucccuguacgcgcaggccucggggcgcgucaccgugagcaccaagcggucccagcagaccgugaucccgaacaucggcucgcgccccuggguccggggcguguccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgucaaccgcaucaccuacggcgccugcccgcgguacgugaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggguccucuggaucucguucgccaucagcugcuuccugcugugcaucgugcuccugggcuucaucaugugggccugccagaaggggaacauccggugcaacaucugcaucuga

SEQ ID NO: 857 - RNA, 1701 nt, Artificial Sequence
  derived and/or modified CDS sequence (AUadapt) from InfluenzaA__ABC50409__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucucgcugcggucccucguggcgagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucucgcuguacgcccaggcguccggccggaucaccgugagcacgaagcgcucgcagcagaccgucaucccgaacaucggcucccggccccgcgugcgggacauccccagccgcaucuccaucuacuggaccaucgugaagcccggggacauccugcucaucaacucgaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 858 - RNA, 1701 nt, Artificial Sequence; identical to SEQ ID NO: 857
  derived and/or modified CDS sequence (AUadapt) from InfluenzaA__ABC50420__HA

SEQ ID NO: 859 - RNA, 1701 nt, Artificial Sequence
  derived and/or modified CDS sequence (AUadapt) from InfluenzaA__ABC54668__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucggguccggccccugggugcgcggcgugucgucccggaucagcaucuacuggacgaucgucaagcccggggacauccuccugaucaacuccaccggcaaccugaucgcgccccgcggguacuucaagauccggucgggcaaguccagcaucaugcgcuccgacgccccgaucggcaagugcaacucggagugcaucacccccaacgggucccuccccaacgacaagcccuuccagaacgugaaccggaucaccuacggcgccugcccgcgcuacgugaagcagaacacgcugaagcuggccaccgggaugcggaacguccccgagaagcagacccgcggcaucuucggggccaucgccggcuucaucgagaacggcugggaggggaugguggacggcugguacggguuccggcaccagaacagcgagggcaccgggcaggccgcggaccucaaguccacgcaggccgccaucaaccagaucaacggcaagcugaaccgccugaucgagaagaccaacgagaaguuccaccagaucgagaaggaguucucggagguggagggccggauccaggaccucgagaaguacgucgaggacaccaagaucgaccugugguccuacaacgccgagcugcucguggcccuggagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcucaagucgggcuacaaggacuggauccuguggaucagcuucgccaucuccugcuuccugcucugcgugguccugcugggcuucaucaugugggccugccagaaggggaacauccgcugcaacaucugcaucuga

SEQ ID NO: 860 - RNA, 1701 nt, Artificial Sequence
  derived and/or modified CDS sequence (AUadapt) from InfluenzaA__ABC54679__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucgucccccaccgggggcaucugcgacagcccccaccagauccucgacggggagaacugcacccugaucgacgcccugcucggcgacccccagugcgacggcuuccagaacaagaagugggaccuguucaucgagcgcuccaaggccuacucgaacugcuacccguacgacgugcccgacuacgcgucccugcggucgcucguggccuccagcgggacgcuggaguucaacaacgaguccuucaacuggaccggcgucacccagaacgggaccucguccgccugcaagcgccggucgaacaacuccuucuucagccgccugaacuggcucacgcaccugaaguucaaguaccccgcccugaacgugaccaugcccaacaacgagaaguucgacaagcucuacaucuggggcgugcaccacccggggaccgacaacgaccagaucucccuguacgcgcaggccucgggccggaucaccgucuccacgaagcgcucgcagcagaccgugauccccaacgugggcagccggccccgcguccgggacauccccucccgcaucucgaucuacuggaccaucgugaagccgggggacauccugcucaucaacuccaccggcaaccugaucgcgccccggggguacuucaagauccgcucgggcaaguccagcaucaugcgguccgacgcccccaucggcaagugcaacucggagugcaucacgcccaacggguccaucccgaacgacaagcccuuccagaacgugaaccgcaucaccuacggcgccugcccccgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcucaagucgggcuacaaggacuggauccuguggaucuccuucgccaucagcugcuuccugcugugcguggcccugcucggguucaucaugugggccugccagaagggcaacauccggugcaacaucugcaucuga

SEQ ID NO: 861 - RNA, 1701 nt, Artificial Sequence; identical to SEQ ID NO: 761
  derived and/or modified CDS sequence (AUadapt) from InfluenzaA__ABC67319__HA

SEQ ID NO: 862 - RNA, 1701 nt, Artificial Sequence
  derived and/or modified CDS sequence (AUadapt) from InfluenzaA__ABC67454__HA
augaagaccaucaucgcccugucguacauccucugccugguguucgcccaggagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucucguucgccaucagcugcuuccugcugugcaucguccuccugggcuucaucaugugggccugccagaaggggaacauccggugcaacaucugcaucuga

SEQ ID NO: 863 - RNA, 1701 nt, Artificial Sequence; identical to SEQ ID NO: 807
  derived and/or modified CDS sequence (AUadapt) from InfluenzaA__ABC67471__HA

SEQ ID NO: 864 - RNA, 1701 nt, Artificial Sequence
  derived and/or modified CDS sequence (AUadapt) from InfluenzaA__ABC67554__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucgugaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 865 - RNA, 1701 nt, Artificial Sequence
  derived and/or modified CDS sequence (AUadapt) from InfluenzaA__ABC67565__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccucggggacccuggaguucaucaacgagggcuucaccuggaccggggugacgcagaacggcggguccaacgccugcaagcggggccccgacaucggcuucuucagccgccugaacuggcucuacaaguccgggucgaccuaccccgugcugaacgucaccaugcccaacaacgacaacuucgacaagcuguacaucuggggcgugcaccacccguccaccgaccaggagcagacgagccucuacgugcaggccuccgggcgggucaccgugagcaccaagcgcucccagcagaccaucauccccaacaucggcucgcggcccugggugcgcggccugagcucccggaucucgaucuacuggacgaucgucaagcccggggacauccuggugaucaacuccaacggcaaccucaucgccccgcgcggguacuucaagaugcggaccggcaagagcuccaucaugcgcagcgacgcgcccaucgggaccugcaucuccgagugcaucacccccaacggcucgauccccaacgacaagccguuccagaacgugaacaagaucacguacggcgccugccccaaguacgucaagcagaacacccugaagcuggccaccgggaugcggaacgugcccgagaagcagacccgcggccucuucggggccaucgccggcuucaucgagaacgggugggagggcaugaucgacggcugguacggguuccggcaccagaacuccgagggcacggggcaggcggccgaccucaagagcacccaggccgccaucgaccagaucaacggcaagcugaaccgcgugaucgagaagaccaacgagaaguuccaccagaucgagaaggaguucuccgaggucgaggggcggauccaggaccucgagaaguacguggaggacaccaagaucgaccuguggucguacaacgccgagcugcucguggcgcuggagaaccagcacacgaucgaccugaccgacuccgagaugaacaagcuguucgagaagacccgccggcagcugcgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcucaaguccggcuacaaggacuggauccuguggaucagcuucgccaucuccugcuuccugcucugcgucgugcugcugggcuucaucaugugggcgugccagaaggggaacauccggugcaacaucugcaucuga

SEQ ID NO: 866 - RNA, 1701 nt, Artificial Sequence
  derived and/or modified CDS sequence (AUadapt) from InfluenzaA__ABC67576__HA
augaagaccaucaucgcccugucguacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccucgaccgggcgcaucugcgacagcccccaccggauccuggacggcgagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacccuggaguucaacaacgagagcuucaacuggacggggguggcccagaacggcaccuccuacgccugcaagcgccggucgaucaaguccuucuucagccgccucaacuggcugcaccagcugaaguacaaguaccccgcgcucaacgugaccaugcccaacaacgacgaguucgacaagcuguacaucuggggcguccaccaccccuccaccgacucggaccagacgucccuguacgcccaggccagcgggcgggugaccgugucgaccaagcgcucccagcagaccgucaucccgaacaucgggagccggcccugggugcgcggcguguccucgcggaucuccaucuacuggacgaucgucaagcccggcgacauccuccugaucaacagcaccgggaaccugaucgcgccccgcggcuacuucaagauccgguccgggaaguccuccaucaugcgcucggacgccccgaucggcaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagucgacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcacccgcaagcagcuccgggagaacgcggaggacaugggcaacgggugcuucaagaucuaccacaagugcgacaacgccugcaucggcucgauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 867 - RNA, 1701 nt, Artificial Sequence
  derived and/or modified CDS sequence (AUadapt) from InfluenzaA__ABC67587__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggccccugcccccgguacgucaagcagaacacccugaagcucgccaccgggaugcgcaacgugcccgagaagcagacgcggggcaucuucggggcgaucgccggcuucaucgagaacggcugggaggggaugguggacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggaccuacgaccacgacgucuaccgggacgaggcgcucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 868 - RNA, 1701 nt, Artificial Sequence; identical to SEQ ID NO: 488
  derived and/or modified CDS sequence (AUadapt) from InfluenzaA__ABC67598__HA

SEQ ID NO: 869 - RNA, 1701 nt, Artificial Sequence; identical to SEQ ID NO: 807
  derived and/or modified CDS sequence (AUadapt) from InfluenzaA__ABC67609__HA

SEQ ID NO: 870 - RNA, 1701 nt, Artificial Sequence; identical to SEQ ID NO: 807
  derived and/or modified CDS sequence (AUadapt) from InfluenzaA__ABC67620__HA

SEQ ID NO: 871 - RNA, 1701 nt, Artificial Sequence; identical to SEQ ID NO: 807
  derived and/or modified CDS sequence (AUadapt) from InfluenzaA__ABC67631__HA

SEQ ID NO: 872 - RNA, 1701 nt, Artificial Sequence; identical to SEQ ID NO: 807
  derived and/or modified CDS sequence (AUadapt) from InfluenzaA__ABC67642__HA

SEQ ID NO: 873 - RNA, 1701 nt, Artificial Sequence
  derived and/or modified CDS sequence (AUadapt) from InfluenzaA__ABC67653__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucucguucgccaucagcugcuuccugcugugcgucgugcuccugggcuucaucaugugggccugccagaaggggaacauccggugcaacaucugcaucuga

SEQ ID NO: 874 - RNA, 1701 nt, Artificial Sequence
  derived and/or modified CDS sequence (AUadapt) from InfluenzaA__ABC67697__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaaggagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 875 - RNA, 1701 nt, Artificial Sequence
  derived and/or modified CDS sequence (AUadapt) from InfluenzaA__ABC67708__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 876 - RNA, 1701 nt, Artificial Sequence; identical to SEQ ID NO: 875
  derived and/or modified CDS sequence (AUadapt) from InfluenzaA__ABC67719__HA

SEQ ID NO: 877 - RNA, 1701 nt, Artificial Sequence; identical to SEQ ID NO: 875
  derived and/or modified CDS sequence (AUadapt) from InfluenzaA__ABC67733__HA

SEQ ID NO: 878 - RNA, 1701 nt, Artificial Sequence
  derived and/or modified CDS sequence (AUadapt) from InfluenzaA__ABC67806__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 879 - RNA, 1701 nt, Artificial Sequence; identical to SEQ ID NO: 761
  derived and/or modified CDS sequence (AUadapt) from InfluenzaA__ABC67817__HA

SEQ ID NO: 880 - RNA, 1701 nt, Artificial Sequence; identical to SEQ ID NO: 875
  derived and/or modified CDS sequence (AUadapt) from InfluenzaA__ABC67828__HA

SEQ ID NO: 881 - RNA, 1701 nt, Artificial Sequence; identical to SEQ ID NO: 739
  derived and/or modified CDS sequence (AUadapt) from InfluenzaA__ABC67839__HA

SEQ ID NO: 882 - RNA, 1701 nt, Artificial Sequence
  derived and/or modified CDS sequence (AUadapt) from InfluenzaA__ABC67850__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggcccggggcguguccucgcgcaucuccauccacuggacgaucgucaagcccggggacauccuccugaucaacagcaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcgccugcccgcgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacuccgagggcaccgggcaggccgcggaccugaaguccacgcaggccgccaucaaccagaucaacggcaagcucaaccggcugaucgagaagaccaacgagaaguuccaccagaucgagaaggaguucuccgagguggagggccgcauccaggaccuggagaaguacguggaggacaccaagaucgaccucuggucguacaacgccgagcugcuggucgcccucgagaaccagcacaccaucgaccugacggacuccgagaugaacaagcuguucgagcggaccaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaaggggguggagcugaaguccggcuacaaggacuggguccucuggaucucguucgccaucagcugcuuccugcugugcaucgugcuccugggcuucaucaugugggccugccagaaggggaacauccggugcaacaucugcaucuga

SEQ ID NO: 883 - RNA, 1701 nt, Artificial Sequence; identical to SEQ ID NO: 739
  derived and/or modified CDS sequence (AUadapt) from InfluenzaA__ABC67861__HA

SEQ ID NO: 884 - RNA, 1701 nt, Artificial Sequence; identical to SEQ ID NO: 807
  derived and/or modified CDS sequence (AUadapt) from InfluenzaA__ABC67883__HA

SEQ ID NO: 885 - RNA, 1701 nt, Artificial Sequence
  derived and/or modified CDS sequence (AUadapt) from InfluenzaA__ABC67894__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucuccaagcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgggugaccgucagcaccaagcgcucccagcagaccgugaucccgaacaucggcucgcggcccugggugcgcggcgucuccagccggaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacugggugcucuggaucucguucgccaucagcugcuuccugcugugcaucguccuccugggcuucaucaugugggccugccagaaggggaacauccgcugcaacaucugcaucuga

SEQ ID NO: 886 - RNA, 1701 nt, Artificial Sequence; identical to SEQ ID NO: 807
  derived and/or modified CDS sequence (AUadapt) from InfluenzaA__ABC67967__HA

SEQ ID NO: 887 - RNA, 1701 nt, Artificial Sequence; identical to SEQ ID NO: 807
  derived and/or modified CDS sequence (AUadapt) from InfluenzaA__ABC67978__HA

SEQ ID NO: 888 - RNA, 1701 nt, Artificial Sequence
  derived and/or modified CDS sequence (AUadapt) from InfluenzaA__ABC67989__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaaggucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacagcaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgugugcaucgggucgauccgcaacggcaccuacgaccacgacgucuaccgggacgaggcgcugaacaaccgcuuccagaucaaggggguggagcugaaguccggcuacaaggacuggguccucuggaucagcuucgccaucagcugcuuccugcugugcaucgugcuccugggcuucaucaugugggccugccagaaggggaacauccggugcaacaucugcaucuga

SEQ ID NO: 889 - RNA, 1701 nt, Artificial Sequence; identical to SEQ ID NO: 862
  derived and/or modified CDS sequence (AUadapt) from InfluenzaA__ABC68000__HA

SEQ ID NO: 890 - RNA, 1701 nt, Artificial Sequence
  derived and/or modified CDS sequence (AUadapt) from InfluenzaA__ABC68049__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccgacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacguguggggcgugcaccaccccgggacggacagcgaccagaucucccuguacgcgcaggccucggggcgcgucaccgugagcaccaagcggucccagcagaccgugaucccgaacaucggcucgcgccccuggguccggggcguguccagcaagaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgucaaccggaucaccuacggcgccugcccgcgcuacgugaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgaggucgagggccggauccaggaccuggagaaguacguggaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggguccucuggaucucguucgccaucagcugcuuccugcugugcaucgugcuccugggcuucaucaugugggccugccagaaggggaacauccgcugcaacaucugcaucuga

SEQ ID NO: 891 - RNA, 1701 nt, Artificial Sequence; identical to SEQ ID NO: 807
  derived and/or modified CDS sequence (AUadapt) from InfluenzaA__ABC68060__HA

SEQ ID NO: 892 - RNA, 1701 nt, Artificial Sequence
  derived and/or modified CDS sequence (AUadapt) from InfluenzaA__ABC68071__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcugaaguccggcuacaaggacugggugcucuggaucucguucgccaucagcugcuuccugcugugcaucguccuccugggcuucaucaugugggccugccagaaggggaacauccggugcaacaucugcaucuga

SEQ ID NO: 893 - RNA, 1701 nt, Artificial Sequence; identical to SEQ ID NO: 875
  derived and/or modified CDS sequence (AUadapt) from InfluenzaA__ABC68082__HA

SEQ ID NO: 894 - RNA, 1701 nt, Artificial Sequence
  derived and/or modified CDS sequence (AUadapt) from InfluenzaA__ABC68093__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcgugaccgucuccaccaagcggucgcagcagaccgugaucccgaacaucgggucccgccccugggugcggggcgucagcuccaucaucucgaucuacuggacgaucgugaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgggaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacucggagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggggucgagcucaagagcggcuacaaggacuggauccuguggaucagcuucgccaccuccugcuuccugcugugcaucgugcuccugggcuucaucaugugggccugccagaaggggaacauccgcugcaacaucugcaucuga

SEQ ID NO: 895 - RNA, 1701 nt, Artificial Sequence
  derived and/or modified CDS sequence (AUadapt) from InfluenzaA__ABC68222__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagccggaucuccaucuacuggacgaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggccugccagaaggggaacauccgcugcaacaucugcaucuga

SEQ ID NO: 896 - RNA, 1701 nt, Artificial Sequence; identical to SEQ ID NO: 687
  derived and/or modified CDS sequence (AUadapt) from InfluenzaA__ABC68233__HA

SEQ ID NO: 897 - RNA, 1707 nt, Artificial Sequence
  derived and/or modified CDS sequence (AUadapt) from InfluenzaA__ABC72655__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaagcccaaccccgccaacgaccucugcuacccgggggacuucaacgacuacgaggagcugaagcaccuccucucccggaucaaccacuucgagaagauccagaucauccccaagagcuccuggagcucccacgaggccucggucggcguguccagcgugugccccuaccagggcaaguccagcuucuuccgcaacgucguguggcugaucaagaagaacuccaccuaccccacgaucaagcggucguacaacaacaccaaccaggaggaccugcucgugcugugggggauccaccacccgaacgacgccgcggagcagaccaagcuguaccagaaccccaccacguacaucuccgucggcaccagcacccucaaccagcgccuggugccccggaucgccacccgcuccaaggugaacgggcagagcggccggauggaguucuucuggacgauccugaagcccaacgacgccaucaacuucgagucgaacgggaacuucaucgccccggaguacgcguacaagaucgucaagaagggcgacuccaccaucaugaaguccgagcucgaguacggcaacugcaacaccaagugccagacccccaugggggccaucaacagcagcaugcccuuccacaacauccacccccugacgaucggcgagugcccgaaguacgugaaguccaaccgccuggugcucgccaccgggcugcggaacucgccccagcgcgagaagcggcgcaagaagcggggccuguucggcgccaucgccggguucaucgagggcggguggcagggcauggucgacgggugguacggcuaccaccacuccaacgagcagggcagcggguacgcggccgacaaggaguccacccagaaggccaucgacggcgugaccaacaaggugaacagcaucaucgacaagaugaacacgcaguucgaggccgucgggcgcgaguucaacaaccucgagcggcgcaucgagaaccugaacaagaagauggaggacggcuuccuggacguguggaccuacaacgccgagcuccugguccugauggagaacgagcggacccucgacuuccacgacuccaacgugaagaaccuguacgacaaggugcgccugcagcuccgggacaacgcgaaggagcuggggaacggcugcuucgaguucuaccacaagugcgacaacgagugcauggagucgguccgcaacggcaccuacgacuacccccaguacuccgaggaggcccggcugaagcgcgaggagaucagcggggugaagcucgaguccaucggcaucuaccagauccugagcaucuacuccacgguggccucgucccuggcccucgccaucauggucgcggggcugagccuguggaugugcagcaacggcucccuccagugccgcaucugcaucuga

SEQ ID NO: 898 - RNA, 1701 nt, Artificial Sequence; identical to SEQ ID NO: 488
  derived and/or modified CDS sequence (AUadapt) from InfluenzaA__ABC84400__HA

SEQ ID NO: 899 - RNA, 1701 nt, Artificial Sequence; identical to SEQ ID NO: 697
  derived and/or modified CDS sequence (AUadapt) from InfluenzaA__ABC84411__HA

SEQ ID NO: 900 - RNA, 1701 nt, Artificial Sequence
  derived and/or modified CDS sequence (AUadapt) from InfluenzaA__ABC84433__HA
augaagaccaucaucgcccugucguacauccucugccugguguucgcccagaagcugcccggcaacgacaaccgcaccgcgacgcucugccuggggcaccacgccgucccgaacggcaccaucgugaagaccaucaccaacgaccagaucgaggugacgaacgccaccgagcugguccaguccucguccaccgggggcaucugcgacagcccccaccagauccucgacggggagaacugcacccugaucgacgcccugcucggcgacccccagugcgacggcuuccagaacaagaagugggaccuguucguggagcgguccaaggccuacucgaacugcuaccccuacgacgugccggacuacgcgucccugcgcucgcucgucgccuccagcgggacgcuggaguucaacaacgaguccuucaacuggaccggcgugacccagaacgggaccucguccgccugcaagcggcgcucgaacaacuccuucuucagccggcugaacuggcucacgcaccugaaguucaaguaccccgcccugaacgugaccaugcccaacaacgagaaguucgacaagcucuacaucuggggcguccaccaccccgggaccaacaacgaccagaucucccuguacgcgcaggccucgggccgcaucaccguguccacgaagcggucgcagcagaccgugaucccgaacaucggcagccgcccccggguccgcgacauccccucccggaucucgaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcucaagucgggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 901 - RNA, 1701 nt, Artificial Sequence; identical to SEQ ID NO: 807
  derived and/or modified CDS sequence (AUadapt) from InfluenzaA__ABC84444__HA

SEQ ID NO: 902 - RNA, 1701 nt, Artificial Sequence; identical to SEQ ID NO: 878
  derived and/or modified CDS sequence (AUadapt) from InfluenzaA__ABC84498__HA

SEQ ID NO: 903 - RNA, 1701 nt, Artificial Sequence; identical to SEQ ID NO: 878
  derived and/or modified CDS sequence (AUadapt) from InfluenzaA__ABC84509__HA

SEQ ID NO: 904 - RNA, 1701 nt, Artificial Sequence
  derived and/or modified CDS sequence (AUadapt) from InfluenzaA__ABC84520__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccgggacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 905 - RNA, 1701 nt, Artificial Sequence
  derived and/or modified CDS sequence (AUadapt) from InfluenzaA__ABC84531__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuucuccaacugcuaccccuacgacgugccggacuacgcgagccugcggucccucgucgccagcuccggcacgcuggaguucaucaacgagggguucaacuggaccggcgugacccagucggggggcuccuacgccugcaagcgcgggagcgugaacuccuucuucucgcggcugaacuggcucuacgaguccgagagcaaguaccccgcccugaacgucaccaugcccaacaacggccgcuucgacaagcuguacaucuggggcgugcaccaccccuccacggacaaggagcagaccaaccucuacgugcgggcggccgggcgcgucaccgugagcaccaagcggucgcagcagacggugaucccgaacaucggcucccgccccuggguccgggggcugagcucccgcaucucgaucuacuggaccaucgugaagcccggcgacauccugcucaucaacuccaccggcaaccugaucgcgccccggggguacuucaagauccgcaccggcaagagcuccaucaugcggagcgacgccccgaucgggacgugcuccucggagugcaucacccccaacggcuccauccccaacgacaagcccuuccagaacgugaacaagaucaccuacggggccugcccgcgcuacgucaagcagaacacccugaagcucgccacgggcaugcggaacgugcccgagaagcagacccgcggcaucuucggggccaucgccggcuucaucgagaacgggugggagggcaugguggacgggugguacggcuuccggcaccagaacagcgagggcaccgggcaggccgccgaccugaaguccacccaggcggccaucgaccagaucaacggcaagcugaaccgccucaucgagaagacgaacgagaaguuccaccagaucgagaaggaguucucggaggucgaggggcggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacaugggcaacgggugcuucaagaucuaccacaagugcgacaacgcgugcaucggcuccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcgucgugcugcucggguucaucaugugggccugccagaagggcaacauccgcugcaacaucugcaucuga

SEQ ID NO: 906 - RNA, 1701 nt, Artificial Sequence; identical to SEQ ID NO: 895
  derived and/or modified CDS sequence (AUadapt) from InfluenzaA__ABC84560__HA

SEQ ID NO: 907 - RNA, 1701 nt, Artificial Sequence
  derived and/or modified CDS sequence (AUadapt) from InfluenzaA__ABC84571__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagaucaucgacggggagaacugcacccugaucgacgcccugcucggcgacccccacugcgacggcuuccagaacaaggagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcguggcccagaacgggaccuccagcgccugcaagcgccgguccaacaagucguucuucucccgccugaacuggcuccaccagcugaaguacaaguaccccgcgcugaacgugaccaugcccaacaacgagaaguucgacaagcucuacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagccggaucuccaucuacuggacgaucgucaagcccggggacauccugcucaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcugaagcucgccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacaccaucgaccucacggacuccgagaugaacaagcuguucgagcgcaccaagaagcagcugcgggagaacgcggaggacauggggaacggcugcuucaagaucuaccacaagugcgacaacgccugcaucgggagcauccgcaacggcaccuacgaccacgacguguaccgcgacgaggcccucaacaaccgguuccagaucaagggggucgagcugaaguccggcuacaaggacuggauccuguggaucucguucgccaucagcugcuuccuccugugcgugguccugcucggcuucaucaugugggccugccagaaggggaacauccgcugcaacaucugcaucuga

SEQ ID NO: 908 - RNA, 1701 nt, Artificial Sequence; identical to SEQ ID NO: 895
  derived and/or modified CDS sequence (AUadapt) from InfluenzaA__ABC85754__HA

SEQ ID NO: 909 - RNA, 1701 nt, Artificial Sequence; identical to SEQ ID NO: 875
  derived and/or modified CDS sequence (AUadapt) from InfluenzaA__ABC85765__HA

SEQ ID NO: 910 - RNA, 1701 nt, Artificial Sequence
  derived and/or modified CDS sequence (AUadapt) from InfluenzaA__ABC85776__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccccggggcgggugaccgugucgaccaagcgcucccagcagaccgucauccccaacaucggcagccggcccugggugcgcggcguguccucgcggaucuccaucuacuggacgaucgucaagcccggggacauccuccugaucaacuucaccggcaaccugaucgccccgcgcggguacuucaagauccggagcggcaaguccucgaucaugcgcuccgacgccagcaucggcaagugcaacuccgagugcaucacccccaacgggucgauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggucgauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 911 - RNA, 1701 nt, Artificial Sequence; identical to SEQ ID NO: 895
  derived and/or modified CDS sequence (AUadapt) from InfluenzaA__ABC85787__HA

SEQ ID NO: 912 - RNA, 1701 nt, Artificial Sequence; identical to SEQ ID NO: 878
  derived and/or modified CDS sequence (AUadapt) from InfluenzaA__ABC85798__HA

SEQ ID NO: 913 - RNA, 1701 nt, Artificial Sequence; identical to SEQ ID NO: 875
  derived and/or modified CDS sequence (AUadapt) from InfluenzaA__ABC85820__HA

SEQ ID NO: 914 - RNA, 1701 nt, Artificial Sequence; identical to SEQ ID NO: 875
  derived and/or modified CDS sequence (AUadapt) from InfluenzaA__ABC85831__HA

SEQ ID NO: 915 - RNA, 1701 nt, Artificial Sequence; identical to SEQ ID NO: 878
  derived and/or modified CDS sequence (AUadapt) from InfluenzaA__ABC85842__HA

SEQ ID NO: 916 - RNA, 1701 nt, Artificial Sequence; identical to SEQ ID NO: 875
  derived and/or modified CDS sequence (AUadapt) from InfluenzaA__ABC85853__HA

SEQ ID NO: 917 - RNA, 1701 nt, Artificial Sequence; identical to SEQ ID NO: 875
  derived and/or modified CDS sequence (AUadapt) from InfluenzaA__ABC85864__HA

SEQ ID NO: 918 - RNA, 1701 nt, Artificial Sequence; identical to SEQ ID NO: 878
  derived and/or modified CDS sequence (AUadapt) from InfluenzaA__ABC85886__HA

SEQ ID NO: 919 - RNA, 1701 nt, Artificial Sequence; identical to SEQ ID NO: 807
  derived and/or modified CDS sequence (AUadapt) from InfluenzaA__ABC85908__HA

SEQ ID NO: 920 - RNA, 1701 nt, Artificial Sequence
  derived and/or modified CDS sequence (AUadapt) from InfluenzaA__ABC85919__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucucguucgccaucagcugcuuccugcugugcaucguccucaugggcuucaucaugugggccugccagaaggggaacauccggugcaacaucugcaucuga

SEQ ID NO: 921 - RNA, 1701 nt, Artificial Sequence; identical to SEQ ID NO: 807
  derived and/or modified CDS sequence (AUadapt) from InfluenzaA__ABC85930__HA

SEQ ID NO: 922 - RNA, 1701 nt, Artificial Sequence; identical to SEQ ID NO: 856
  derived and/or modified CDS sequence (AUadapt) from InfluenzaA__ABC85941__HA

SEQ ID NO: 923 - RNA, 1701 nt, Artificial Sequence
  derived and/or modified CDS sequence (AUadapt) from InfluenzaA__ABC85952__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaagaagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccacaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucucguucgccaucagcugcuuccugcugugcaucguccuccugggcuucaucaugugggccugccagaaggggaacauccggugcaacaucugcaucuga

SEQ ID NO: 924 - RNA, 1701 nt, Artificial Sequence; identical to SEQ ID NO: 807
  derived and/or modified CDS sequence (AUadapt) from InfluenzaA__ABC85974__HA

SEQ ID NO: 925 - RNA, 1701 nt, Artificial Sequence; identical to SEQ ID NO: 807
  derived and/or modified CDS sequence (AUadapt) from InfluenzaA__ABC85985__HA

SEQ ID NO: 926 - RNA, 1701 nt, Artificial Sequence
  derived and/or modified CDS sequence (AUadapt) from InfluenzaA__ABC85996__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugauggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 927 - RNA, 1701 nt, Artificial Sequence; identical to SEQ ID NO: 488
  derived and/or modified CDS sequence (AUadapt) from InfluenzaA__ABC86007__HA

SEQ ID NO: 928 - RNA, 1701 nt, Artificial Sequence
  derived and/or modified CDS sequence (AUadapt) from InfluenzaA__ABC86018__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcaccaucaucgacgcccugcugggcgacccccagugcgacggcuuccagaacaagaagugggaccucuucguggagcgcuccaaggccuacuccaacugcuaccccuacgacgugccggacuacgcgucgcugcggucccuggucgccagcuccgggacgcucgaguucaacaacgagucguucaacuggaccggcgugacccagaacgggaccuccagcgccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaucucgcucuacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcugaucaacagcaccggcaaccucaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagucgacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 929 - RNA, 1701 nt, Artificial Sequence; identical to SEQ ID NO: 488
  derived and/or modified CDS sequence (AUadapt) from InfluenzaA__ABC86029__HA

SEQ ID NO: 930 - RNA, 1701 nt, Artificial Sequence; identical to SEQ ID NO: 527
  derived and/or modified CDS sequence (AUadapt) from InfluenzaA__ABC86040__HA

SEQ ID NO: 931 - RNA, 1701 nt, Artificial Sequence; identical to SEQ ID NO: 761
  derived and/or modified CDS sequence (AUadapt) from InfluenzaA__ABC86124__HA

SEQ ID NO: 932 - RNA, 1701 nt, Artificial Sequence; identical to SEQ ID NO: 838
  derived and/or modified CDS sequence (AUadapt) from InfluenzaA__ABC86137__HA

SEQ ID NO: 933 - RNA, 1701 nt, Artificial Sequence
  derived and/or modified CDS sequence (AUadapt) from InfluenzaA__ABC97374__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaacgagggcuucaccuggaccggggugacgcagaacggcggguccaacgccugcaagcggggccccgacagcggcuucuucucccgccugaacuggcucuacaagucgggguccaccuaccccgugcugaacgucaccaugcccaacaacgacaacuucgacaagcuguacaucuggggcgugcaccacccgagcaccgaccaggagcagacgucccucuacgugcaggccucggggcgggucaccguguccaccaagcgcagccagcagaccaucauccccaacaucggcucgcggcccugggugcgcggccuguccagccggaucuccaucuacuggacgaucgucaagcccggggacauccuggugaucaacagcaacggcaaccucaucgccccgcgcggguacuucaagaugcggaccggcaaguccucgaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcuggccaccgggaugcggaacgugcccgagaagcagacccgcggccucuucggggccaucgccggcuucaucgagaacgggugggagggcaugguggacggcugguacggguuccggcaccagaacucggagggcacggggcaggcggccgaccugaaguccacccaggccgccaucgaccagaucaacggcaagcugaaccgcgucaucgagaagaccaacgagaaguuccaccagaucgagaaggaguucagcgagguggaggggcggauccaggaccucgagaaguacguggaggacaccaagaucgaccugugguccuacaacgccgagcugcucgucgcgcuggagaaccagcacacgaucgaccugaccgacucggagaugaacaagcuguucgagaagacccgccggcagcuccgcgagaacgccgaggacaugggcaacggcugcuuccggaucuaccacaagugcgacaacgccugcaucggguccauccgcaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggugcugcugggcuucaucaugugggcgugccagaaggggaacauccgcugcaacaucugcaucuga

SEQ ID NO: 934 - RNA, 1701 nt, Artificial Sequence; identical to SEQ ID NO: 277
  derived and/or modified CDS sequence (AUadapt) from InfluenzaA__ABD15449__HA

SEQ ID NO: 935 - RNA, 1701 nt, Artificial Sequence
  derived and/or modified CDS sequence (AUadapt) from InfluenzaA__ABD15460__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagccccuaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucgacuggaccggcgugacccagaacgggaccucguccgccugcaagcgccggagcaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugucgacgaagcgcucgcagcagaccgugaucccgaacaucggcucccggccccgcguccgggacgugagcucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 936 - RNA, 1701 nt, Artificial Sequence; identical to SEQ ID NO: 277
  derived and/or modified CDS sequence (AUadapt) from InfluenzaA__ABD15471__HA

SEQ ID NO: 937 - RNA, 1701 nt, Artificial Sequence; identical to SEQ ID NO: 277
  derived and/or modified CDS sequence (AUadapt) from InfluenzaA__ABD15482__HA

SEQ ID NO: 938 - RNA, 1701 nt, Artificial Sequence; identical to SEQ ID NO: 935
  derived and/or modified CDS sequence (AUadapt) from InfluenzaA__ABD15493__HA

SEQ ID NO: 939 - RNA, 1701 nt, Artificial Sequence; identical to SEQ ID NO: 488
  derived and/or modified CDS sequence (AUadapt) from InfluenzaA__ABD15526__HA

SEQ ID NO: 940 - RNA, 1701 nt, Artificial Sequence; identical to SEQ ID NO: 697
  derived and/or modified CDS sequence (AUadapt) from InfluenzaA__ABD15537__HA

SEQ ID NO: 941 - RNA, 1701 nt, Artificial Sequence; identical to SEQ ID NO: 697
  derived and/or modified CDS sequence (AUadapt) from InfluenzaA__ABD15548__HA

SEQ ID NO: 942 - RNA, 1701 nt, Artificial Sequence; identical to SEQ ID NO: 715
  derived and/or modified CDS sequence (AUadapt) from InfluenzaA__ABD15559__HA

SEQ ID NO: 943 - RNA, 1701 nt, Artificial Sequence; identical to SEQ ID NO: 697
  derived and/or modified CDS sequence (AUadapt) from InfluenzaA__ABD15570__HA

SEQ ID NO: 944 - RNA, 1701 nt, Artificial Sequence; identical to SEQ ID NO: 715
  derived and/or modified CDS sequence (AUadapt) from InfluenzaA__ABD15581__HA

SEQ ID NO: 945 - RNA, 1701 nt, Artificial Sequence; identical to SEQ ID NO: 697
  derived and/or modified CDS sequence (AUadapt) from InfluenzaA__ABD15592__HA

SEQ ID NO: 946 - RNA, 1701 nt, Artificial Sequence; identical to SEQ ID NO: 697
  derived and/or modified CDS sequence (AUadapt) from InfluenzaA__ABD15603__HA

SEQ ID NO: 947 - RNA, 1701 nt, Artificial Sequence; identical to SEQ ID NO: 697
  derived and/or modified CDS sequence (AUadapt) from InfluenzaA__ABD15614__HA

SEQ ID NO: 948 - RNA, 1701 nt, Artificial Sequence
  derived and/or modified CDS sequence (AUadapt) from InfluenzaA__ABD15625__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucgacuggaccggcgugacccagaacgggaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccucgggccggaucaccgugagcacgaagcgcucccagcagaccgugaucccgaacaucggcucgcggccccgcguccgggacguguccucgcagaucuccaucuacuggaccaucgugaagcccggggacauccugcucaucaacagcaccggcaaccugaucgcgccccgcggguacuucaagauccgguccggcaagucguccaucaugcgcagcgacgccccgaucggcaagugcaacuccgagugcaucacgcccaacgggucgauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggugaaguacgucgaggacacgaagaucgaccuguggucguacaacgccgagcuccugguggcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggacguacgaccacgacguguaccgcgacgaggcccucaacaaccgguuccagaucaagggcgucgagcugaaguccggcuacaaggacuggauccuguggaucucguucgccaucagcugcuuccuccugugcguggcccugcucggguucaucaugugggccugccagaagggcaacauccgcugcaacaucugcaucuga

SEQ ID NO: 949 - RNA, 1701 nt, Artificial Sequence; identical to SEQ ID NO: 715
  derived and/or modified CDS sequence (AUadapt) from InfluenzaA__ABD15636__HA

SEQ ID NO: 950 - RNA, 1701 nt, Artificial Sequence; identical to SEQ ID NO: 895
  derived and/or modified CDS sequence (AUadapt) from InfluenzaA__ABD15680__HA

SEQ ID NO: 951 - RNA, 1701 nt, Artificial Sequence
  derived and/or modified CDS sequence (AUadapt) from InfluenzaA__ABD15691__HA
augaagaccaucaucgcccugucguacauccucugccugguguucgcccagaagcugcccgucaacgacaaguccaccgcgacgcucugccugggccaccacgccgugccgaacgggacccuggugaagaccaucaccaacgaccacaucgaggucacgaacgccaccgagcucgugcagagcucccccaccggccgcaucugcgacucgccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcucgcugguggccuccagcggcacccuggaguucaacaacgaguccuucaacuggaccggcguggcccagaacgggaccucguccgccugcaagcggcgcagcaucaaguccuucuucucgcggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggccucggggcgcgugaccgucagcaccaagcggucccagcagacggugauccccaacaucggcucgcgccccugggugcgcggggucuccagccggaucuccaucuacuggaccaucgugaagcccggcgacauccuccugaucaacucgaccggcaaccugaucgccccgcggggguacuucaagauccgcuccggcaagagcuccaucaugcggucgaacgcccccaucgggaagugcaacuccgagugcaucacccccaacggcagcauccccaacgacaagccguuccagaacgugaaccgcaucacguacggcgcgugcccccgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgcggaccucaagucgacccaggccgccaucaaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggucgauccggaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 952 - RNA, 1701 nt, Artificial Sequence
  derived and/or modified CDS sequence (AUadapt) from InfluenzaA__ABD15702__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaccagccuguacgcccaggccccggggcgggugaccgugucgaccaagcgcucccagcagacggucauccccaacaucggcagccggcccugggugcgcggcguguccucgcggaucuccaucuacuggaccaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucacguacggcgcgugcccgcgcuacgugaagcagaacacccucaagcuggccaccgggaugcggaacguccccgagaagcagacccgcggcaucuucggggccaucgccggcuucaucgagaacggcugggaggggaugguggacggcugguacggguuccggcaccagaacuccgagggcacggggcaggccgcggaccugaaguccacccaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacacgaucgaccugaccgacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggccugccagaaggggaacauccgcugcaacaucugcaucuga

SEQ ID NO: 953 - RNA, 1701 nt, Artificial Sequence
  derived and/or modified CDS sequence (AUadapt) from InfluenzaA__ABD15724__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacguggccaugcccaacaacgagaaguucgacaagcuguacaucuggggcguccaccaccccagcaccgacuccgaccagaucucgcuguacgcccaggccccggggcgggugacggugagcaccaagcgcucccagcagaccgucauccccaacaucggcucgcggcccugggugcgcggcguguccagccggaucuccaucuacuggaccaucgucaagcccggggacauccuccugaucaacugcacgggcaaccugaucgccccgcgcggguacuucaagauccggucgggcaaguccagcaucaugcgcuccgacgcgucgaucggcaagugcaacuccgagugcaucacccccaacgggagcauccccaacgacaagcccuuccagaacgugaaccggaucaccuacggcgccugcccgcgcuacgugaagcagaacacccucaagcuggccacggggaugcggaacguccccgagaagcagacccgcggcaucuucggggccaucgccggcuucaucgagaacggcugggaggggaugguggacggcugguacggguuccggcaccagaacuccgagggcaccgggcaggcggccgaccugaaguccacccaggccgccaucaaccagaucaacggcaagcucaaccgccugaucgagaagacgaacgagaaguuccaccagaucgagaaggaguucuccgagguggagggccggauccaggaccuggagaaguacgucgaggacaccaagaucgaccucuggucguacaacgccgagcugcugguggcgcucgagaaccagcacaccaucgaccugaccgacuccgagaugaacaagcuguucgagcgcacgaagaagcagcuccgggagaacgccgaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggcgugccagaaggggaacauccgcugcaacaucugcaucuga

SEQ ID NO: 954 - RNA, 1701 nt, Artificial Sequence
  derived and/or modified CDS sequence (AUadapt) from InfluenzaA__ABD15746__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgggggaucagcucccgcaucagcaucuacuggaccaucgucaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggagaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggguucaucaugugggccugccagaagggcaacauccgcugcaacaucugcaucuga

SEQ ID NO: 955 - RNA, 1701 nt, Artificial Sequence
  derived and/or modified CDS sequence (AUadapt) from InfluenzaA__ABD15757__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggagaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 956 - RNA, 1701 nt, Artificial Sequence; identical to SEQ ID NO: 895
  derived and/or modified CDS sequence (AUadapt) from InfluenzaA__ABD15779__HA

SEQ ID NO: 957 - RNA, 1701 nt, Artificial Sequence; identical to SEQ ID NO: 895
  derived and/or modified CDS sequence (AUadapt) from InfluenzaA__ABD15790__HA

SEQ ID NO: 958 - RNA, 1701 nt, Artificial Sequence; identical to SEQ ID NO: 895
  derived and/or modified CDS sequence (AUadapt) from InfluenzaA__ABD16292__HA

SEQ ID NO: 959 - RNA, 1701 nt, Artificial Sequence; identical to SEQ ID NO: 878
  derived and/or modified CDS sequence (AUadapt) from InfluenzaA__ABD16303__HA

SEQ ID NO: 960 - RNA, 1701 nt, Artificial Sequence; identical to SEQ ID NO: 878
  derived and/or modified CDS sequence (AUadapt) from InfluenzaA__ABD16325__HA

SEQ ID NO: 961 - RNA, 1701 nt, Artificial Sequence
  derived and/or modified CDS sequence (AUadapt) from InfluenzaA__ABD16336__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccucguccgggacccuggaguucaacaacgagagcuucaacuggaccggcgucacccagaacgggacguccucggccugcaagcgccgguccaacagcuccuucuucucgcgccugaacuggcucacccaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucacggucagcaccaagcgcucccagcagaccgugaucccgaacaucggcucgcggccccgcgugcgggacauccccucccgcaucagcaucuacuggaccaucgucaagcccggggacauccugcucaucaacuccacgggcaaccugaucgccccgcggggguacuucaagauccgcucgggcaaguccucgaucaugcgguccgacgcccccaucggcaagugcaacagcgagugcaucacccccaacggguccauccccaacgacaagccguuccagaacgugaaccgcaucaccuacggcgccugcccccgguacgugaagcagaacacccugaagcucgcgacggggaugcgcaacguccccgagaagcagacccggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 962 - RNA, 1701 nt, Artificial Sequence; identical to SEQ ID NO: 878
  derived and/or modified CDS sequence (AUadapt) from InfluenzaA__ABD16347__HA

SEQ ID NO: 963 - RNA, 1701 nt, Artificial Sequence
  derived and/or modified CDS sequence (AUadapt) from InfluenzaA__ABD16358__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgaccuggagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacguguaccgggacgaggcccugaacaaccgcuuccagaucaagggcgucgagcugaaguccggcuacaaggacuggauccucuggaucagcuucgccaucuccugcuuccugcugugcguggcccuccugggguucaucaugugggccugccagaagggcaacauccggugcaacaucugcaucuga

SEQ ID NO: 964 - RNA, 1701 nt, Artificial Sequence; identical to SEQ ID NO: 878
  derived and/or modified CDS sequence (AUadapt) from InfluenzaA__ABD16472__HA

SEQ ID NO: 965 - RNA, 1701 nt, Artificial Sequence; identical to SEQ ID NO: 878
  derived and/or modified CDS sequence (AUadapt) from InfluenzaA__ABD16483__HA

SEQ ID NO: 966 - RNA, 1701 nt, Artificial Sequence; identical to SEQ ID NO: 875
  derived and/or modified CDS sequence (AUadapt) from InfluenzaA__ABD16494__HA

SEQ ID NO: 967 - RNA, 1701 nt, Artificial Sequence; identical to SEQ ID NO: 878
  derived and/or modified CDS sequence (AUadapt) from InfluenzaA__ABD16505__HA

SEQ ID NO: 968 - RNA, 1701 nt, Artificial Sequence
  derived and/or modified CDS sequence (AUadapt) from InfluenzaA__ABD16516__HA
augaagaccaucaucgcccugucguacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucaucgagcgcuccaaggccuacuccaacugcuaccccuacgacgugccggacuacgcgucgcugcggucccugguggccagcuccgggacgcucgaguucaacaacgagucguucaacuggaccggcgucacccagaacgggaccuccagcgccugcaagcgccgguccaacaacucguucuucucccgccugaacuggcugacgcaccucaaguucaaguaccccgcccugaacgugaccaugcccaacaacgagaaguucgacaagcuguacaucuggggcgugcaccaccccgggaccgacaacgaccagaucucgcucuacgcgcaggccuccggccggaucaccgucagcacgaagcgcucgcagcagaccgugaucccgaacaucggcucccggccccgcgugcgggacauccccucgcgcaucuccaucuacuggaccaucgucaagcccggggacauccugcugaucaacagcaccggcaaccucaucgccccgcggggguacuucaagauccgcuccggcaagucguccaucaugcggagcgacgcccccaucgacaagugcaacuccgagugcaucacgcccaacggcucgauccccaacgacaagccguuccagaacgugaaccgcaucaccuacggggccugcccccgguacgugaagcagaacacccugaagcuggcgaccggcaugcgcaacguccccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucaaccagaucaacgggaagcugaaccggcugaucggcaagaccaacgagaaguuccaccagaucgagaaggaguucuccgagguggagggccgcauccaggaccucgagaaguacgucgaggacaccaagguggaccuguggagcuacaacgccgagcugcucguggcccuggagaaccagcacacgaucgaccugaccgacuccgagaugaacaagcuguucgagcggaccaagaagcagcuccgcgagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 969 - RNA, 1701 nt, Artificial Sequence
  derived and/or modified CDS sequence (AUadapt) from InfluenzaA__ABD16527__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccucgaccggcgggaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggaccacgcgucgcugcggucccucgucgccagcuccggcacgcuggaguucaacaacgagucguucgacuggaccggggugacccagaacggcaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucggggcggaucaccgugucgacgaagcgcucccagcagaccgugaucccgaacaucggcagccggccccgcguccgggacguguccucgcgcaucuccaucuacuggaccaucgugaagcccggcgacauccugcucaucaacucgaccgggaaccugaucgcgccccggggcuacuucaagauccgcuccgggaaguccuccaucaugcggagcgacgccccgaucggcaagugcaacuccgagugcaucacgcccaacggcucgauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagucgacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcacguacgaccacgacguguaccgggacgaggcccucaacaaccgcuuccagaucaaggggguggagcugaaguccggcuacaaggacuggauccuguggaucucguucgccaucagcugcuuccuccugugcgucgcccugcucggcuucaucaugugggccugccagaaggggaacauccggugcgacaucugcaucuga

SEQ ID NO: 970 - RNA, 1701 nt, Artificial Sequence; identical to SEQ ID NO: 761
  derived and/or modified CDS sequence (AUadapt) from InfluenzaA__ABD16538__HA

SEQ ID NO: 971 - RNA, 1701 nt, Artificial Sequence
  derived and/or modified CDS sequence (AUadapt) from InfluenzaA__ABD16549__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucgugugggccugccagaagggcaacauccggugcaacaucugcaucuga

SEQ ID NO: 972 - RNA, 1701 nt, Artificial Sequence; identical to SEQ ID NO: 875
  derived and/or modified CDS sequence (AUadapt) from InfluenzaA__ABD16560__HA

SEQ ID NO: 973 - RNA, 1701 nt, Artificial Sequence
  derived and/or modified CDS sequence (AUadapt) from InfluenzaA__ABD16571__HA
augaagaccaucaucgcccugucguacaucuucugccucguggucgcccagaagcugcccggcaacgacaacuccaccgcgacgcugugccucgggcaccacgccgugccgaacggcaccaucgugaagaccaucaccaacgaccagaucgaggucacgaacgccaccgagcuggugcagagcuccucgaccgggcgcaucugcaacagcccccaccggauccuggacggcaagaacugcacccucaucgacgcccugcugggggacccccacugcgacuccuuccagaacaaggagugggaccucuucguggagcgcuccaaggccuacucgaacugcuaccccuacgacgucccggacuacgcgucccugcggagccugguggccuccucgggcacgcucgaguucaucaacgaggacuucaacuggaccggcguggcccaguccgggggcagcuacgccugcaagcgcggguccgucaacucguucuucucccggcugaacuggcugcacgagagcgaguacaaguaccccgcgcucaacgugaccaugcccaacaacggcaaguucgacaagcuguacaucuggggcgugcaccaccccuccaccgaccgcgagcagacgaaccuguacguccgggccucggggcgcgugaccgugagcaccaagcggucccagcagaccgucaucccgaacaucggcucgcgccccugggugcgggggcucuccagccgcaucuccaucuacuggacgaucgugaagcccggcgacauccugcugaucaacucgaccgggaaccucaucgcgccccggggcuacuucaagauccgcaccggcaaguccagcaucaugcgguccgacgccccgaucgggaccugcucguccgagugcaucacgcccaacggcagcauccccaacgacaagcccuuccagaacgucaaccgcaucaccuacggggccugcccgcgguacgugaagcagaacacccugaagcuggccaccggcaugcgcaacgugcccgagaagcagacgcgggggaucuucggcgccaucgccggcuucaucgagaacgggugggagggcauggucgacgggugguacggcuuccgccaccagaacuccgaggggaccggccaggccgccgaccucaagucgacccaggcggccaucgaccagaucaacggcaagcugaaccggcugaucgagaagaccaacgagaaguuccaccagaucgagaaggaguucuccgagguggaggggcgcauccaggaccucgagaaguacguggaggacacgaagaucgaccuguggagcuacaacgccgagcugcucgucgcccuggagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcgucgagcucaaguccggcuacaaggacuggauccuguggaucagcuucgccaucagcugcuuccugcucugcguggugcugcugggguucaucaugugggccugccagaagggcaacauccggugcaacaucugcaucuga

SEQ ID NO: 974 - RNA, 1701 nt, Artificial Sequence
  derived and/or modified CDS sequence (AUadapt) from InfluenzaA__ABD16718__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacucgccccaccggauccucgacggcaagaacugcacccugaucgacgcccugcucggggacccccacugcgacggcuuccagaacgagaagugggaccuguucaucgagcgcagcaaggccuucuccaacugcuaccccuacgacgugccggacuacgcgagccugcggucccucguggccucguccggcacgcuggaguucaucaacgagggguucaacuggaccggcgucacccagagcgggggcuccuacgccugcaagcgcgggagcgugaacuccuucuucucgcggcugaacuggcucuacgaguccgaguacaaguaccccgcccugaacgugaccaugcccaacaacggcaaguucgacaagcuguacaucuggggcguccaccaccccaucacggagaaggagcagaccaaccucuacgugcgcgcgagcgggcgggugaccgucuccaccaagcgcagccagcagacggugaucccgaacaucggcucgcggcccugggugcgcgggcuguccagccggaucuccaucuacuggaccaucgucaagcccggcgacauccugcucaucaacagcaccggcaaccugaucgcgccccgcggguacuucaagauccggaccggcaaguccucgaucaugcgcuccgacgccccgaucgggacgugcagcuccgagugcaucacccccaacggcagcauccccaacgacaagcccuuccagaacgugaacaagaucaccuacggggccugcccgcgguacgugaagcagaacacccugaagcucgccacgggcaugcgcaacguccccgagaagcagacccggggcaucuucggggccaucgccggcuucaucgagaacgggugggagggcaugguggacgggugguacggcuuccgccaccagaacuccgagggcaccgggcaggccgccgaccugaaguccacccaggccgcgaucgaccagaucaacggcaagcugaaccggcucaucgagaagacgaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgcggaagcagcugcgcgagaacgccgaggacaugggcaacgggugcuucaagaucuaccacaagugcgacaacgccugcaucggcagcauccgcaacggcaccuacgaccacgacguguaccgggacgaggcgcucaacaaccgcuuccagaucaagggggucgagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 975 - RNA, 1701 nt, Artificial Sequence
  derived and/or modified CDS sequence (AUadapt) from InfluenzaA__ABD16729__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgucgcugcggucccucgucgccagcuccggcacgcuggaguucaucaacgagggguucaacuggaccggcgugacccagaacgggggcagcuacacgugcaagcgcggguccgugaacucguucuucucccggcugaacuggcucuacgagagcgaguccaaguaccccguccugaacgugaccaugcccaacaacggcaaguucgacaagcuguacaucuggggcgugcaccaccccagcaccgacaaggagcagaccaaccucuacguccgcgccuccgggaaggugaccgugucgacgaagcggagccagcagaccgucaucccgaacaucggcucccgccccugggugcgggggcugucgucccgcaucagcaucuacuggaccaucgugaagcccggcgacauccugcucaucaacuccaccggcaaccugaucgcgccccggggguacuucaagauccgcacgggcaagagcuccaucaugcggucggacgccccgaucgggaccugcuccagcgagugcaucacccccaacggcuccauccccaacgacaagcccuuccagaacgucaacaagaucaccuacggggccugcccgcgcuacgugaagcagaacacgcugaagcucgccaccggcaugcggaacgugcccgagaagcagacccgcggcaucuucggggccaucgccggcuucaucgagaacgggugggagggcauggucgacgggugguacggcuuccggcaccagaacagcgagggcaccgggcaggcggccgaccugaaguccacgcaggccgccaucgaccagaucaacggcaagcugaaccgccucaucgagaagaccaacgagaaguuccaccagaucgagaaggaguucucggagguggaggggcggauccaggaccuggagaaguacguggaggacaccaagaucgaccugugguccuacaacgccgagcuccuggucgcgcuggagaaccagcacaccaucgaccucacggacagcgagaugaacaagcuguucgagaagacccgcaagcagcugcgggagaacgccgaggacaugggcaacgggugcuucaagaucuaccacaagugcgacaacgccugcaucggcuccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggugcugcucggguucaucaugugggcgugccagaagggcaacauccgcugcaacaucugcaucuga

SEQ ID NO: 976 - RNA, 1701 nt, Artificial Sequence
  derived and/or modified CDS sequence (AUadapt) from InfluenzaA__ABD16751__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccacucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccagcgccugcaagcgggggcccgacaacggcuucuucucccgccugaacuggcucuacaagucgggcuccaccuaccccgugcagaacgucacgaugcccaacaacgacaacucggacaagcuguacaucuggggcgugcaccacccguccaccgacaaggagcagaccgaccuguacgugcaggccagcgggaaggucaccguguccacgaagcggucgcagcagaccgugauccccaacgucgggagccgccccugggugcggggccucuccucgcgcguguccaucuacuggaccaucgucaagcccggcgacauccuggugaucaacagcaacgggaaccugaucgcgccgcggggcuacuucaagaugcgcaccgggaaguccucgaucaugcgguccgacgcccccaucggcacgugcucguccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcucgauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccgcugcaacaucugcaucuga

SEQ ID NO: 977 - RNA, 1701 nt, Artificial Sequence; identical to SEQ ID NO: 838
  derived and/or modified CDS sequence (AUadapt) from InfluenzaA__ABD16762__HA

SEQ ID NO: 978 - RNA, 1701 nt, Artificial Sequence; identical to SEQ ID NO: 550
  derived and/or modified CDS sequence (AUadapt) from InfluenzaA__ABD17323__HA

SEQ ID NO: 979 - RNA, 1701 nt, Artificial Sequence; identical to SEQ ID NO: 807
  derived and/or modified CDS sequence (AUadapt) from InfluenzaA__ABD38134__HA

SEQ ID NO: 980 - RNA, 1698 nt, Artificial Sequence; identical to SEQ ID NO: 546
  derived and/or modified CDS sequence (AUadapt) from InfluenzaA__ABD60779__HA

SEQ ID NO: 981 - RNA, 1701 nt, Artificial Sequence
  derived and/or modified CDS sequence (AUadapt) from InfluenzaA__ABD60790__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccucgaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcucgcucgucgcguccagcgggacccuggaguucaucaacgagggcuucaccuggaccggggugacgcagaacggcggguccaacgccugcaagcggggccccgacagcggcuucuucucccgccugaacuggcucuacaagucgggguccaccuaccccgugcugaacgucaccaugcccaacaacgacaacuucgacaagcuguacaucuggggcgugcaccacccgagcaccgaccaggagcagacgucccucuacgugcaggccucggggcgggucaccguguccaccaagcgcagccagcagaccaucauccccaacaucggcucgcggcccugggugcgcggccuguccagccggaucuccaucuacuggacgaucgucaagcccggggacauccugaucaucaacagcaacggcaaccucaucgccccgcgcggguacuucaagaugcggaccggcaaguccucgaucaugcgcuccgacgcgcccaucgggaccugcaucagcgagugcaucacccccaacggcuccauccccaacgacaagccguuccagaacgugaacaagaucacguacggcgccugccccaaguacgugaagcagaacacccugaagcuggccaccgggaugcggaacguccccgagaagcagacccgcggcaucuucggggccaucgccggcuucaucgagaacgggugggagggcaugaucgacggcugguacggguuccggcaccagaacucggagggcacggggcaggcggccgaccucaaguccacccaggccgccaucgaccagaucaacggcaagcugaaccgcaucaucgagaagaccaacgagaaguuccaccagaucgagaaggaguucagcgagguggaggggcggauccaggaccuggagaaguacguggaggacaccaagaucgaccucugguccuacaacgccgagcugcuggucgcgcucgagaaccagcacacgaucgaccugaccgacucggagaugaacaagcuguucgagaagacccgccggcagcuccgcgagaacgccgaggacaugggcaacggcugcuucaagaucuaccacaagugcgacaacgccugcaucggguccauccggaacggcaccuacgaccacgacguguaccgcgacgaggcccugaacaaccgcuuccagaucaaggggguggagcucaagagcggcuacaaggacuggauccuguggaucuccuucgccaucagcugcuuccugcugugcgucgugcuccugggcuucaucaugugggcgugccagaaggggaacauccggugcaacaucugcaucuga

SEQ ID NO: 982 - RNA, 1701 nt, Artificial Sequence
  derived and/or modified CDS sequence (AUadapt) from InfluenzaA__ABD60801__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgccugugcgacagcccccaccggauccuggacggcaagaacugcacccucaucgacgcccugcugggggacccccacugcgacggcuuccagaacaaggagugggaccucuucguggagcgcucgaaggccuacuccaacugcuaccccuacgacgugccggacuacgcgagccugcggucccuggucgccucguccggcacgcucgaguucaucaacgaggacuucaacuggaccgggguggcccaggacggcgggagcuacgccugccgccggggcuccgugaacucguucuucucccgccugaacuggcugcacaagcucgaguacaaguaccccgcgcugaacgucaccaugcccaacaacgggaaguucgacaagcuguacaucuggggcgugcaccaccccagcaccgacuccgaccagacgucgcucuacgugcgggccuccggccgcgucaccgugagcaccaagcggucgcagcagaccgugaucccgaacaucgggucccgccccuggguccggggccagagcucccgcaugucgaucuacuggacgaucgugaagcccggggacauccugcugaucaacuccaccggcaaccucaucgcgccccggggcuacuucaagauccgcaacgggaaguccuccaucaugcggagcgacgccccgaucggcaacugcuccucggagugcaucacccccaacggguccauccccaacgacaagcccuuccagaacgugaaccgcaucaccuacggcgccugcccgcgguacgucaagcagcacacgcugaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccucaaguccacgcaggcggccaucgaccagaucaacgggaagcugaaccggcugaucgagaagaccaacgagaaguuccaccagaucgagaaggaguucucggaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagcgcacccggaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 983 - RNA, 1701 nt, Artificial Sequence
  derived and/or modified CDS sequence (AUadapt) from InfluenzaA__ABD60812__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagucguccagcaccgggggcaucugcgacucgccccaccagauccucgacggggagaacugcacccugaucgacgcccugcucggcgacccccagugcgacggcuuccagaacaagaagugggaccuguucgucgagcgcagcaaggccuacuccaacugcuaccccuacgacgugccggacuacgcgucgcugcggucccucguggccagcuccgggacgcuggaguucaacaacgagucguucaacuggaccggcgucacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucuuccuguacgcgcaggccagcggccggaucaccgucuccacgaagcgcucgcagcagaccgugaucccgagcaucggcucccggccccgcgugcggaacauccccucgcgcaucuccaucuacuggaccaucgucaagcccggggacauccugcucaucaacagcaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 984 - RNA, 1701 nt, Artificial Sequence; identical to SEQ ID NO: 878
  derived and/or modified CDS sequence (AUadapt) from InfluenzaA__ABD60823__HA

SEQ ID NO: 985 - RNA, 1701 nt, Artificial Sequence
  derived and/or modified CDS sequence (AUadapt) from InfluenzaA__ABD60845__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggaccagaacgggaccuccucggccugcaagcggcgcuccacgaaguccuucuucucccggcucaacuggcugcaccagcugaaguacaaguaccccgcccucaacgucaccaugcccaacaacgagaaguucgacaagcuguacaucuggggcgugcaccaccccagcaccgacuccgaccagaucucgcuguacgcgcaggccagcgggcgcgugaccgucuccacgaagcggucgcagcagaccgugaccccgaacaucggcucccgccccugggugcgcggggucagcucccggaucucgaucuacuggaccaucgugaagcccggcgacauccuccugaucaacuccacgggcaaccugaucgcgccccggggguacuucaagauccgcagcggcaaguccucgaucaugcgguccaacgcccucaucgggaagugcaacagcgagugcaucaccccgaacggcuccauccccaacgacaagcccuuccagaacgugaaccgcaucaccuacggcgccugcccccgguacgucaagcagaacacccugaagcuggccacggggaugcgcaacgugccggagaagcagacccggggcaucuucggggccaucgccggcuucaucgagaacgggugggagggcaugguggacggcugguacggguuccgccaccagaacucggagggcaccgggcaggccgccgaccucaaguccacccaggcggccaucaaccagaucaacggcaagcugaaccggcugaucgagaagacgaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugaccgacucggagaugaacaagcuguucgagcggacgcgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 986 - RNA, 1698 nt, Artificial Sequence
  derived and/or modified CDS sequence (AUadapt) from InfluenzaA__ABD60878__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugagcgucgugagcucccacuacucgcggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 987 - RNA, 1698 nt, Artificial Sequence
  derived and/or modified CDS sequence (AUadapt) from InfluenzaA__ABD60889__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 988 - RNA, 1698 nt, Artificial Sequence
  derived and/or modified CDS sequence (AUadapt) from InfluenzaA__ABD60900__HA
augaaggugaagcgccugguccuccugugcaccuucaccgccacguacgccgacaccaucugcaucggcuaccacgcgaacaacucgaccgacaccguggacacggugcuggagaagaacgucaccgugacccacuccgugaaccuccuggaggacagccacaacgggaagcugugccuccugaagggcaucgcgccccugcagcucgggaacugcuccgucgccggcuggauccuggggaacccggagugcgagcugcucaucagcaaggaguccuggucguacaucguggagacccccaaccccgagaacggcacgugcuaccccggcuacuucgccgacuacgaggagcugcgggagcagcuguccagcguguccagcuucgagcgcuucgagaucuucccgaaggaguccagcuggcccaaccacaccgucaccgggguguccgccucgugcucccacaacggcaagagcuccuucuaccggaaccuccuguggcugaccgggaagaacggccucuaccccaaccugagcaaguccuacgccaacaacaaggagaaggaggugcugguccucuggggcgugcaccacccgcccaacaucggggaccagaaggcccuguaccacacggagaacgccuacgugucggucgugagcucccacuacagccgccgguucacccccgagaucgccaagcgccccaaggugcgggaccaggagggccgcaucaacuacuacuggacccugcucgagcccggggacaccaucaucuucgaggcgaacggcaaccugaucgccccgcgguacgccuucgcccugucccgcggguucggcagcggcaucaucacguccaacgcccccauggacgagugcgacgcgaagugccagacgccccagggggccaucaacucgucccuccccuuccagaacguccacccggugaccaucggcgagugccccaaguacgugcggagcgccaagcugcgcauggucaccgggcugcggaacauccccuccauccagagccgcggccucuucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacucggucaucgagaagaugaacacccaguucacggccguggggaaggaguucaacaagcuggagcggcgcauggagaaccugaacaagaaggucgacgacggcuuccucgacaucuggaccuacaacgccgagcugcuggugcuccuggagaacgagcggacccuggacuuccacgacagcaacgugaagaaccucuacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgacgguggccagcucccuggugcuccuggucagccugggggccaucuccuucuggaugugcagcaacggcucccuccagugccggaucugcaucuga

SEQ ID NO: 989 - RNA, 1698 nt, Artificial Sequence
  derived and/or modified CDS sequence (AUadapt) from InfluenzaA__ABD60911__HA
augaaggccaagcugauggugcuccugugcaccuucaccgccacguacgcggacaccaucugcaucggcuaccacgccaacaacucgaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagcugcucaucagcaaggaguccuggagcuacaucgucgagacccccaaccccgagaacggcacgugcuaccccggcuacuucgccgacuacgaggagcugcgcgagcagcuguccucgguguccagcuucgagcgguucgagaucuucccgaaggaguccagcuggcccaaccacaccgugaccggggucuccgccagcugcucccacaacggcaagucguccuucuaccgcaaccuccuguggcugaccgggaagaacggccucuaccccaaccugagcaaguccuacgccaacaacaaggagaaggaggugcuggugcucuggggcguccaccacccgcccaacaucggggaccagcgggcccuguaccacacggagaacgccuacgugagcguggucagcucccacuacucgcgccgguucacccccgagaucgcgaagcgccccaaggugcgggaccaggagggccgcaucaacuacuacuggacccugcucgagcccggggacaccaucaucuucgaggccaacggcaaccugaucgccccgugguacgccuucgcccugucccggggguucggcagcggcaucaucacguccaacgcgcccaugggggagugcgacgccaagugccagacgccccagggcgccaucaacagcucccuccccuuccagaacgugcacccggucaccaucggggagugccccaaguacgugcgcagcgccaagcugcggauggugaccggccugcgcaacauccccuccauccagucgcggggccucuucggggccaucgcgggcuucaucgagggcggguggaccgggauggucgacggcugguacggguaccaccaccagaacgagcagggcuccggcuacgccgccgaccagaaguccacccagaacgccaucgacgggaucaccaacaaggugaacagcaucaucgagaagaugaacacccaguucacggccgugggcaaggaguucaacaagcuggagcgccggauggagaaccugaacaagaaggucgacgacggguuccucgacaucuggaccuacaacgcggagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagucgaagcugaaccgggagaagaucgacggcgucaagcucgaguccauggggguguaccagauccuggccaucuacagcacgguggccagcucccugguccuccuggugagccugggcgccaucuccuucuggaugugcagcaacgggucccuccagugccgcaucugcaucuga

SEQ ID NO: 990 - RNA, 1701 nt, Artificial Sequence; identical to SEQ ID NO: 277
  derived and/or modified CDS sequence (AUadapt) from InfluenzaA__ABD60922__HA

SEQ ID NO: 991 - RNA, 1701 nt, Artificial Sequence
  derived and/or modified CDS sequence (AUadapt) from InfluenzaA__ABD60933__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcucgaucgccggcuggauccuggggaacccggagugcgagucccucgugagcaagaaguccuggucguacaucgccgagacccccaacuccgagaacgggaccugcuaccccggcuacuucgccgacuacgaggagcugcgggagcagcugagcuccgucagcuccuucgagcgcuucgagaucuuccccaaggagcggucguggccgaagcacaacgugacccgcggcgugacggccuccugcagccacaagggcaaguccucguucuaccggaaccuccuguggcugaccgagaagaacggguccuaccccaaccucagcaagucguacgucaacaacaaggagaaggaggugcuggugcuguggggcguccaccaccccuccaacaucgaggaccagaagaccaucuaccgcaaggagaacgccuacgugagcguggucuccagcaacuacaaccggcgcuucacccccgagaucgcggagcggccgaaggugcgcgggcaggccggccggaucaacuacuacuggacgcuccuggagcccggcgacaccaucaucuucgaggccaacgggaaccugaucgcccccuggcacgccuucgcgcucaaccgcggcuucggguccggcaucaucaccucgaacgccuccauggacgagugcgacaccaagugccagacgccccagggcgccaucaacagcucccugccguuccagaacauccaccccgugaccaucggggagugccccaaguacguccggucgaccaagcugcgcauggugaccggccuccggaacauccccuccauccagagccgcgggcuguucggcgccaucgccggguucaucgagggcggcuggacggggaugaucgacggcugguacggguaccaccaccagaacgagcagggcuccggguacgcggccgaccagaaguccacccagaacgccaucaacggcaucaccaacaaggugaacucggucaucgagaagaugaacacccaguucacggccgugggcaaggaguucaacaagcuggagaagcggauggagaaccucaacaagaagguggacgacggguuccuggacaucuggaccuacaacgccgagcugcucguccugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuacccgaaguacuccgaggagucgaagcucaaccgggagaagaucgacggggugaagcuggagagcaugggcgucuaccagauccuggccaucuacuccacgguggccucgucccucgugcugcuggucagccucggcgccaucuccuucuggaugugcagcaacgggucccugcagugccgcaucugcaucuga

SEQ ID NO: 992 - RNA, 1701 nt, Artificial Sequence
  derived and/or modified CDS sequence (AUadapt) from InfluenzaA__ABD60944__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagcggagcuggccgaagcacaacgucacccgcggcgugacggccuccugcagccacaagggcaaguccucguucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucucggugguguccagcaacuacaaccggcgcuucacccccgagaucgcggagcggccgaagguccgcgggcaggccggccggaucaacuacuacuggacgcuccuggagcccggcgacaccaucaucuucgaggccaacgggaaccugaucgcccccugguacgccuucgcgcucucccgcggcuucgggagcggcaucaucaccuccaacgccucgauggacgagugcgacaccaagugccagacgccccagggcgccaucaacuccagccugccguuccagaacgugcaccccgugaccaucggggagugccccaaguacguccgguccaccaagcugcgcauggugaccggccuccggaacauccccagcauccagucccgcgggcuguucggcgccaucgccggguucaucgagggcggcuggacggggaugaucgacggcugguacggguaccaccaccagaacgagcagggcucgggguacgcggccgaccagaaguccacccagaacgccaucaacggcaucaccaacaaggugaacagcgucaucgagaagaugaacacccaguucacggccgugggcaaggaguucaacaagcuggagaagcggauggagaaccucaacaagaagguggacgacggguuccuggacaucuggaccuacaacgccgagcugcucguccugcuggagaacgagcgcacccucgacuuccacgacuccaacgugaagaaccuguacgagaaggucaagagccagcugaagaacaacgcgaaggagaucggcaacgggugcuucgaguucuaccacaagugcaacaacgagugcauggaguccgugaagaacggcaccuacgacuacccgaaguacucggaggagagcaagcucaaccgggagaagaucgacggggugaagcuggaguccaugggcgucuaccagauccuggccaucuacagcacgguggccuccucgcucgugcugcuggucucccucggcgccaucagcuucuggaugugcuccaacgggagccugcagugccgcaucugcaucuga

SEQ ID NO: 993 - RNA, 1701 nt, Artificial Sequence
  derived and/or modified CDS sequence (AUadapt) from InfluenzaA__ABD60955__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccgaagugcgagagccuguucuccaaggagagcugguccuacaucgccgagacccccaaccccgagaacgggaccugcuaccccggcuacuucgccgacuacgaggagcuccgggagcagcugucguccgucagcuccuucgagcgcuucgagaucuucccgaaggagagcuccuggcccaaccacacggugaccaagggggugaccaccagcugcucccacaacggcaagucguccuucuaccggaaccugcucuggcugacggagaagaacgggcuguaccccaaccucagcaaguccuacgucaacaacaaggagaaggaggugcuggugcuguggggcguccaccaccccagcaacauccgcgaccagcgggccaucuaccacaccgagaacgccuacgugagcguggucuccagccacuacucccgccgguucaccccggagaucgcgaagcgccccaaggugcgggaccaggaggggcgcaucaacuacuacuggacccuccuggagcccggcgacacgaucaucuucgaggccaacggcaaccugaucgcccccugguacgccuucgcccucucgcggggguucggcuccgggaucaucaccagcaacgcguccauggacgagugcgacgccaagugccagaccccgcagggcgccaucaacagcucccugcccuuccagaacgugcaccccgucaccaucggcgagugccccaaguacgugcgcagcacgaagcugcggauggugaccgggcuccgcaacaucccguccauccagucgcggggccuguucggggccaucgccggcuucaucgagggcggcuggaccggcaugaucgacgggugguacggcuaccaccaccagaacgagcagggguccggcuacgcggccgaccagaaguccacccagaacgccaucaacgggaucacgaacaaggucaacagcgugaucgagaagaugaacacccaguucaccgccgugggcaaggaguucaacaagcuggagcgccggauggagaaccucaacaagaaggucgacgacggcuuccuggacaucuggaccuacaacgccgagcugcucgugcugcuggagaacgggcgcacgcucgacuuccacgacagcaacgucaagaaccuguacgagaaggugaagucccagcugaagaacaacgcgaaggagaucggcaacgggugcuucgaguucuaccacaagugcaacaacgagugcauggagagcgugaagaacggcaccuacgacuaccccaaguacuccgaggagucgaagcucaaccgggggaagaucgacggcgucaagcuggagagcaugggcguguaccagauccuggccaucuacuccaccguggccagcucccucguccugcuggugagccucggggccaucuccuucuggaugugcagcaacggcucccugcagugccgcaucugcaucuga

SEQ ID NO: 994 - RNA, 1701 nt, Artificial Sequence; identical to SEQ ID NO: 277
  derived and/or modified CDS sequence (AUadapt) from InfluenzaA__ABD61260__HA

SEQ ID NO: 995 - RNA, 1701 nt, Artificial Sequence; identical to SEQ ID NO: 277
  derived and/or modified CDS sequence (AUadapt) from InfluenzaA__ABD61271__HA

SEQ ID NO: 996 - RNA, 1701 nt, Artificial Sequence; identical to SEQ ID NO: 531
  derived and/or modified CDS sequence (AUadapt) from InfluenzaA__ABD61282__HA

SEQ ID NO: 997 - RNA, 1701 nt, Artificial Sequence; identical to SEQ ID NO: 761
  derived and/or modified CDS sequence (AUadapt) from InfluenzaA__ABD61293__HA

SEQ ID NO: 998 - RNA, 1701 nt, Artificial Sequence; identical to SEQ ID NO: 983
  derived and/or modified CDS sequence (AUadapt) from InfluenzaA__ABD61304__HA

SEQ ID NO: 999 - RNA, 1701 nt, Artificial Sequence; identical to SEQ ID NO: 895
  derived and/or modified CDS sequence (AUadapt) from InfluenzaA__ABD61315__HA

SEQ ID NO: 1000 - RNA, 1701 nt, Artificial Sequence; identical to SEQ ID NO: 317
  derived and/or modified CDS sequence (AUadapt) from InfluenzaA__ABD61337__HA

SEQ ID NO: 1001 - RNA, 1701 nt, Artificial Sequence
  derived and/or modified CDS sequence (AUadapt) from InfluenzaA__ABD61348__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacaacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 1002 - RNA, 1701 nt, Artificial Sequence; identical to SEQ ID NO: 317
  derived and/or modified CDS sequence (AUadapt) from InfluenzaA__ABD61359__HA

SEQ ID NO: 1003 - RNA, 1701 nt, Artificial Sequence; identical to SEQ ID NO: 955
  derived and/or modified CDS sequence (AUadapt) from InfluenzaA__ABD61370__HA

SEQ ID NO: 1004 - RNA, 1701 nt, Artificial Sequence; identical to SEQ ID NO: 895
  derived and/or modified CDS sequence (AUadapt) from InfluenzaA__ABD61381__HA

SEQ ID NO: 1005 - RNA, 1701 nt, Artificial Sequence
  derived and/or modified CDS sequence (AUadapt) from InfluenzaA__ABD61392__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgcggcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgcgugaccgugagcaccaagcggucccagcagaccgucauccccaacaucggcucgcgccccugggugcgcgggguguccagccggaucuccaucuacuggacgaucgucaagcccggcgacauccuccugaucaacugcaccgggaaccugaucgccccgcggggcuacuucaagauccgcucgggcaaguccagcaucaugcgguccgacgccucgaucgggaagugcaacuccgagugcaucacccccaacggcagcauccccaacgacaagcccuuccagaacgugaaccgcaucaccuacggggcgugcccgcgguacgugaagcagaacacgcucaagcuggccaccggcaugcgcaacguccccgagaagcagacccgggggaucuucggcgccaucgccggcuucaucgagaacgggugggagggcaugguggacgggugguacggcuuccgccaccagaacuccgaggggaccggccaggccgcggaccugaaguccacgcaggccgccaucaaccagaucaacggcaagcucaaccggcugaucgagaagaccaacgagaaguuccaccagaucgagaaggaguucuccgagguggaggggcgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgcuuccagaucaagggcgucgagcugaaguccggcuacaaggacuggauccucuggaucucguucgccaucagcugcuuccugcugugcgugguccuccugggguucaucaugugggccugccagaagggcaacauccggugcaacaucugcaucuga

SEQ ID NO: 1006 - RNA, 1701 nt, Artificial Sequence; identical to SEQ ID NO: 985
  derived and/or modified CDS sequence (AUadapt) from InfluenzaA__ABD61403__HA

SEQ ID NO: 1007 - RNA, 1701 nt, Artificial Sequence
  derived and/or modified CDS sequence (AUadapt) from InfluenzaA__ABD61529__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgucgcugcggucccucgucgccagcuccggcacgcuggaguucaucaacgagggguucaacuggaccggcgugacccagagcgggggcuccuacgccugcaagcgcgggucggugaacuccuucuucagccggcugaacuggcucuacgaguccgagagcaaguaccccguccugaacgugaccaugcccaacaacggcaaguucgacaagcuguacaucuggggcgugcaccaccccuccacggacaaggagcagaccaaccucuacguccgcgccucggggcgggugaccgugagcaccaagcgcucccagcagacggucaucccgaacaucggcagccggcccugggugcgcgggcuguccucgcggaucuccaucuacuggaccaucgugaagcccggcgacauccugcucaucaacagcaccggcaaccugaucgcgccccgcggguacuucaagauccggaccggcaaguccagcaucaugcgcuccgacgccccgaucgggacgugcucguccgagugcaucacccccaacggcagcauccccaacgacaagcccuuccagaacgucaacaagaucaccuacggggccugcccgcgguacgugaagcagaacacccugaagcucgccacgggcaugcgcaacgugcccgagaagcagacccggggcaucuucggggccaucgcgggcuucaucgagaacgggugggagggcauggucgacgggugguacggcuuccgccaccagaacuccgagggcaccgggcaggccgccgaccugaaguccacccaggccgccaucgaccagaucaacggccggcugaaccgccucaucgagaagacgaacgagaaguuccaccagaucgagaaggaguucuccgagguggaggggcggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgcaagcagcugcgcgagaacgccgaggacaugggcaacgggugcuucaagaucuaccacaagugcgacaacgccugcaucggcucgauccggaacggcaccuacgaccacgacguguaccgcgacgaggcccucaacaaccgguuccagaucaagggggucgagcugaaguccggcuacaaggacuggauccuguggaucagcuucgcgaucagcugcuuccuccugugcguggugcugcucggguucaucaugugggccugccagaagggcaacauccgcugcaacaucugcaucuga

SEQ ID NO: 1008 - RNA, 1698 nt, Artificial Sequence; identical to SEQ ID NO: 986
  derived and/or modified CDS sequence (AUadapt) from InfluenzaA__ABD61540__HA

SEQ ID NO: 1009 - RNA, 1701 nt, Artificial Sequence
  derived and/or modified CDS sequence (AUadapt) from InfluenzaA__ABD61757__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccagcgccugcaagcgggggcccgacaacggcuucuucucccgccugaacuggcucuacaagucgggcuccaccuaccccgugcagaacgucacgaugcccaacaacgacaacucggacaagcuguacaucuggggcgugcaccacccguccaccgacaaggagcagaccgaccuguacgugcaggccagcgggaaggucaccguguccacgaagcggucgcagcagaccgugauccccaacgucgggagccgccccugggugcggggccucuccucgcgcguguccaucuacuggaccaucgucaagcccggcgacauccuggugaucaacagcaacgggaaccugaucgcgccgcggggcuacuucaagaugcgcaccgggaaguccucgaucaugcgguccgacgcccccaucggcacgugcucguccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcucgauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccgcugcaacaucugcaucuga

SEQ ID NO: 1010 - RNA, 1701 nt, Artificial Sequence
  derived and/or modified CDS sequence (AUadapt) from InfluenzaA__ABD61777__HA
augaagaccaucaucgcccugucguacaucuucugccucggcuucgcccagaagcugcccgggaacgacaacuccaccgcgacgcugugccucggccaccacgccgugccgaacgggacccuggucaagaccaucaccaacgaccagaucgaggugacgaacgccaccgagcuggugcagagcuccucgaccggccgcaucugcgacagcccccaccggauccucgacgggaagaacugcacccugaucgacgcccugcucggcgacccccacugcgacggcuuccagaacgagaagugggaccuguucgucgagcgcucgaaggccuucuccaacugcuaccccuacgacgugccggacuacgcgagccugcggucccucguggccucguccgggacgcuggaguucaucaacgagggcuucaacuggaccggggucacccagagcggcggguccuacgccugcaagcgcggcagcgugaacuccuucuucucgcggcugaacuggcucuacgaguccgagagcaaguaccccgcccugaacgugaccaugcccaacaacggcaaguucgacaagcuguacaucuggggcguccaccaccccuccacggacaaggagcagaccaaccucuacgugcgcgcgucggggcgggugaccgucagcaccaagcgcucccagcagacggugaucccgaacaucgggucgcggcccugggugcgcggccuguccagccggaucuccaucuacuggaccaucgucaagcccggcgacauccugcucaucaacagcaccgggaaccugaucgcgccccgcggcuacuucaagauccggaccgggaaguccucgaucaugcgcuccgacgccccgaucggcacgugcagcuccgagugcaucacccccaacgggucgauccccaacgacaagcccuuccagaacgugaacaagaucaccuacggcgccugcccgcgguacgugaagcagaacacccugaagcucgccacgggcaugcgcaacguccccgagaagcagacccgggggaucuucggcgccaucgccggguucaucgagaacggcugggaggggaugguggacggcugguacggcuuccgccaccagaacuccgaggggaccggccaggccgccgaccugaaguccacccaggccgcgaucgaccagaucaacgggaagcugaaccggcucaucgagaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgcggaagcagcugcgcgagaacgccgaggacauggggaacggcugcuucaagaucuaccacaagugcgacaacgccugcaucggcucgauccgcaacgggaccuacgaccacgacguguaccgggacgaggcgcucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 1011 - RNA, 1701 nt, Artificial Sequence
  derived and/or modified CDS sequence (AUadapt) from InfluenzaA__ABD77598__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcucccccaccggccgcaucugcgacucgccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcucgcugguggccuccagcggcacccuggaguucaacaacgaguccuucaacuggaccggcguggcccagaacgggaccucguccgccugcaagcggcgcagcaucaaguccuucuucucgcggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggccucggggcgcgugaccgucagcaccaagcggucccagcagacggugauccccaacaucggcucgcgccccugggugcgcggggucuccagccggaucuccaucuacuggaccaucgugaagcccggcgacauccuccugaucaacucgaccggcaaccugaucgccccgcggggguacuucaagauccgcuccggcaagagcuccaucaugcggucgaacgcccccaucgggaagugcaacuccgagugcaucacccccaacggcagcauccccaacgacaagccguuccagaacgugaaccgcaucacguacggcgcgugcccccgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgcggaccucaagucgacccaggccgccaucaaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggucgauccggaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 1012 - RNA, 1701 nt, Artificial Sequence; identical to SEQ ID NO: 895
  derived and/or modified CDS sequence (AUadapt) from InfluenzaA__ABD77609__HA

SEQ ID NO: 1013 - RNA, 1701 nt, Artificial Sequence; identical to SEQ ID NO: 895
  derived and/or modified CDS sequence (AUadapt) from InfluenzaA__ABD77620__HA

SEQ ID NO: 1014 - RNA, 1701 nt, Artificial Sequence; identical to SEQ ID NO: 895
  derived and/or modified CDS sequence (AUadapt) from InfluenzaA__ABD77631__HA

SEQ ID NO: 1015 - RNA, 1701 nt, Artificial Sequence; identical to SEQ ID NO: 895
  derived and/or modified CDS sequence (AUadapt) from InfluenzaA__ABD77642__HA

SEQ ID NO: 1016 - RNA, 1701 nt, Artificial Sequence; identical to SEQ ID NO: 895
  derived and/or modified CDS sequence (AUadapt) from InfluenzaA__ABD77653__HA

SEQ ID NO: 1017 - RNA, 1698 nt, Artificial Sequence; identical to SEQ ID NO: 986
  derived and/or modified CDS sequence (AUadapt) from InfluenzaA__ABD77708__HA

SEQ ID NO: 1018 - RNA, 1698 nt, Artificial Sequence
  derived and/or modified CDS sequence (AUadapt) from InfluenzaA__ABD77719__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcggaaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 1019 - RNA, 1698 nt, Artificial Sequence; identical to SEQ ID NO: 986
  derived and/or modified CDS sequence (AUadapt) from InfluenzaA__ABD77730__HA

SEQ ID NO: 1020 - RNA, 1701 nt, Artificial Sequence; identical to SEQ ID NO: 895
  derived and/or modified CDS sequence (AUadapt) from InfluenzaA__ABD77752__HA

SEQ ID NO: 1021 - RNA, 1701 nt, Artificial Sequence; identical to SEQ ID NO: 895
  derived and/or modified CDS sequence (AUadapt) from InfluenzaA__ABD77763__HA

SEQ ID NO: 1022 - RNA, 1701 nt, Artificial Sequence
  derived and/or modified CDS sequence (AUadapt) from InfluenzaA__ABD77774__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgacaacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggaccagaacgggaccuccucggccugcaagcggcgcuccaacaagagcuucuucucccggcucaacuggcugcaccagcugaaguacaaguaccccgcccucaacgucacgaugcccaacaacgagaaguucgacaagcuguacaucuggggcgugcaccaccccucgaccgacuccgaccagaucagccuguacgcgcaggccucggggcgcgugaccgucuccaccaagcggagccagcagacggugaucccgaacaucggcucccgccccugggugcgcggggucucgucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccagaacggcuccauccccaacgacaagcccuuccagaacgugaaccgcaucacguacggcgccugcccccgguacgucaagcagaacacccucaagcuggccaccgggaugcgcaacgugccggagaagcagacccggggcaucuucggggccaucgccggcuucaucgagaacgggugggagggcaugguggacggcugguacggguuccgccaccagaacagcgagggcacggggcaggccgccgaccugaaguccacccaggcggccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 1023 - RNA, 1701 nt, Artificial Sequence; identical to SEQ ID NO: 1022
  derived and/or modified CDS sequence (AUadapt) from InfluenzaA__ABD77785__HA

SEQ ID NO: 1024 - RNA, 1701 nt, Artificial Sequence
  derived and/or modified CDS sequence (AUadapt) from InfluenzaA__ABD77807__HA
augaaggccaagcugcucauccugcugugcgcccucucggcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagucgcuccuguccaagcggagcugguccuacaucgccgagacccccaacucggagaacgggaccugcuaccccggcgacuucgccgacuacgaggagcugcgcgagcagcucuccagcguguccucguucgagcgguucgagaucuuccccaaggagcgcuccuggccgaagcacaacaucacccgcggggugacggccgccugcagccacgcgggcaaguccucguucuacaagaaccugcuguggcucaccgagaccaacggguccuaccccaagcugagcaaguccuacgucaacaacaaggagaaggaggugcuggugcucuggggcguccaccaccccucgaacaucgaggaccagaagacccuguaccggaaggagaacgccuacgugagcguggucuccucgaacuacaaccggcgcuucacgcccgagaucgccgagcggccgaaggugcgcgggcaggccggccggaugaacuacuacuggacccugcucgagcccggcgacaccaucaucuucgaggccaacgggaaccugaucgcgcccugguacgccuucgcccugucccgcggcuucgggagcggcaucaucaccuccaacgccucgauggacgagugcgacacgaagugccagacgccccagggcgccaucaacuccagccucccguuccagaacauccaccccgugaccaucggggagugccccaaguacgucaaguccaccaagcugcggauggugaccggccugcgcaacauccccucgauccagucccggggccucuucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacucggucaucgagaagaugaacacgcaguucaccgcggugggcaaggaguucaacaagcuggagaagcgcauggagaaccugaacaagaagguggacgacggguuccucgacaucuggaccuacaacgccgagcugcugguccuccuggagaacgagcggacccuggacuuccacgacuccaacgugaagaaccucuacgagaaggugaagaaccagcugcgcaacaacgccaaggagaucggcaacgggugcuucgaguucuaccacaagugcaacaacgagugcauggagagcgucaagaacggcacguacgacuacccgaaguacuccgaggagucgaagcugaaccgggagaagaucgacggggugaagcucgaguccaugggcgucuaccagauccuggccaucuacagcaccguggccucgucccuggugcuccuggucagccugggcgcgaucuccuucuggaugugcagcaacgggucccuccagugccgcaucugcaucuga

SEQ ID NO: 1025 - RNA, 1701 nt, Artificial Sequence
  derived and/or modified CDS sequence (AUadapt) from InfluenzaA__ABD77818__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagucguccuggccgaagcacaccgucacgcgcggggugaccgccagcugcucccacaagggcaagagcuccuucuaccggaaccuccuguggcugaccgagaagaacgggucguaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacgcccgagaucgcgaagcgcccgaagguccgggaccaggaggggcgcaucaacuacuacuggacccuccuggagcccggcgacaccaucaucuucgaggccaacggcaaccugaucgcccccugguacgccuucgcccucucgcggggguucggcuccgggaucaucaccagcaacgcguccauggacgagugcgacgccaagugccagacgccccagggcgccaucaacagcucccugccguuccagaacgugcaccccgugaccaucggcgagugccccaaguacguccgcucgaccaagcugcggauggugaccgggcuccgcaacauccccuccauccagagccggggccuguucggggccaucgccggcuucaucgagggcggcuggacgggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagaagcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggucaagucccagcucaagucgaacgcgaaggagaucgggaacggcugcuucgaguucuaccacaagugcaacaacgagugcauggagagcgugaagaacgggaccuacgacuacccgaaguacuccgaggagagcaagcugaaccgcgagaagaucgacggcgugaagcuggaguccaugggggucuaccagauccuggccaucuacucgacgguggccuccagccucgugcugcuggucucccucggcgccaucagcuucuggaugugcuccaacggcagccugcagugccggaucugcaucuga

SEQ ID NO: 1026 - RNA, 1701 nt, Artificial Sequence
  derived and/or modified CDS sequence (AUadapt) from InfluenzaA__ABD77829__HA
augaagaccaucaucgcccugucguacauccucuaccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgccugugcgacagcccccaccggauccuggacggcaagaacugcacccucaucgacgcccugcugggggacccccacugcgacggcuuccagaacaaggagugggaccucuucguggagcgcucgaaggccuacuccgacugcuaccccuacgacgugccggacuacgcgagccugcggucccuggucgccucguccggcacgcucgaguucaccaacgagggguucaacuggaccggcguggcccagaacgggaccagcuacgccugcaagcgcggcuccgugaaguccuucuucucccggcugaacuggcugcacaagcucgaguacaaguaccccgcgcugaacgucacgaugcccaacaacgacaaguucgacaagcuguacaucuggggcgugcaccaccccucgaccgacuccgaccagaccagccucuacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccugcugaucaacuccaccgggaaccucaucgcgccccggggcuacuucaagauccgcucgggcaaguccagcaucaugcgguccgacgccccgaucgggaacugcaacucggagugcaucacgcccaacggcuccauccccaacgacaagcccuuccagaacgucaaccgcaucaccuacggggccugcccgcgguacgugaagcagaacacccugaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccucaaguccacccaggcggccaucaaccagaucaacggcaagcugaaccggcugaucgagaagaccaacgagaaguuccaccagaucgagaaggaguucucggagguggaggggcgcauccaggaccucgagaaguacguggaggacacgaagaucgaccugugguccuacaacgccgagcugcucgucgcccuggagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagucgggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 1027 - RNA, 1701 nt, Artificial Sequence
  derived and/or modified CDS sequence (AUadapt) from InfluenzaA__ABD77862__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccgacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagcaucuacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccugcucaucaacuccaccgggaaccugaucgcgccccggggcuacuucaagauccgcucgggcaaguccagcaucaugcgguccgacgccccgaucgggaacugcaacucggagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcugaaccggcucaucgagaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggacccgcaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcgucgagcucaagucgggcuacaaggacuggauccuguggaucuccuucgccaucagcugcuuccugcugugcguggugcugcucggguucaucaugugggccugccagaagggcaacauccgcugcaacaucugcaucuga

SEQ ID NO: 1028 - RNA, 1701 nt, Artificial Sequence
  derived and/or modified CDS sequence (AUadapt) from InfluenzaA__ABD77884__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggagcuccaccggccgcaucugcgacucgccccaccggauccuggacgggaagaacugcacccugaucgacgcccuccugggcgacccccacugcgacggcuuccagaacaaggagugggaccuguucguggagcgcuccaaggccuacagcaacugcuaccccuacgacgugccggacuacgcgucccuccggucgcuggucgccuccagcgggacgcuggaguucaacaacgaguccuucaacuggaccggcguggcccagaacgggaccucguacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccucgacggacuccgaccagaccagccuguacgugcaggccuccgggcgggucaccgugucgaccaagcgcagccagcagacggugaucccgaacaucggcucccggcccuggguccgcggcgugucgucccggaucagcaucuacuggaccaucgugaagcccggggacauccuccugaucaacuccaccggcaaccugaucgcgccccgcggguacuucaagauccggucgggcaaguccagcaucaugcgcuccgacgccccgaucgacaacugcaacucggagugcaucacccccaacggcuccauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggguucaucgagaacggcugggagggcauggucgacgggugguacggcuuccggcaccagaacagcgaggggacgggccaggccgccgaccugaaguccacccaggcggccaucaaccagaucaacgggaagcucaaccgccugaucgagaagaccaacgagaaguuccaccagaucgagaaggaguucucggagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagucgggguacaaggacuggauccuguggaucuccuucgccaucagcugcuuccugcugugcguggugcuccugggcuucaucaugugggccugccagaagggcaacauccggugcaacaucugcaucuga

SEQ ID NO: 1029 - RNA, 1701 nt, Artificial Sequence
  derived and/or modified CDS sequence (AUadapt) from InfluenzaA__ABD77895__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccuacgccugcaagcgccggagcgugaaguccuucuucucgcgccucaacuggcugcacaagcuggaguacaaguaccccgcgcucaacgucaccaugcccaacaacgacaaguucgacaagcuguacaucuggggcgugcaccaccccuccacggacagcgaccagaccucccuguacgugcaggccucggggcgggucaccgugagcaccaagcgcucccagcagacggugaucccgaacaucgggucgcggcccuggguccgcggcaucuccagccggaucuccaucuacuggaccaucgugaagcccggcgacauccuccugaucaacagcaccgggaaccugaucgcgccccgcggcuacuucaagauccgguccgggaaguccuccaucaugcgcucggacgccccgaucgacaacugcaacuccgagugcaucacccccaacggcagcauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacuccgagggcacggggcaggccgccgaccucaagucgacccaggcggccaucaaccagaucuccggcaagcugaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacucggagaugaacaagcuguucgagcgcacccgcaagcagcuccgggagaacgccgaggacaugggcaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucagcuucgccaucuccugcuuccugcugugcgucgugcuccugggguucaucaugugggccugccagaagggcaacauccggugcaacaucugcaucuga

SEQ ID NO: 1030 - RNA, 1701 nt, Artificial Sequence; identical to SEQ ID NO: 1028
  derived and/or modified CDS sequence (AUadapt) from InfluenzaA__ABD77906__HA

SEQ ID NO: 1031 - RNA, 1698 nt, Artificial Sequence
  derived and/or modified CDS sequence (AUadapt) from InfluenzaA__ABD77917__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagaaggcccuguaccacacggagaacgccuacgugagcgucgugagcucccacuacucgcggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1032 - RNA, 1698 nt, Artificial Sequence
  derived and/or modified CDS sequence (AUadapt) from InfluenzaA__ABD77928__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaagaaggugcucguccuguggggcgugcaccacccgcccaacaucggggaccagaaggcccuguaccacacggagaacgccuacgugagcgucgugagcucccacuacucgcggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1033 - RNA, 1698 nt, Artificial Sequence; identical to SEQ ID NO: 987
  derived and/or modified CDS sequence (AUadapt) from InfluenzaA__ABD77939__HA

SEQ ID NO: 1034 - RNA, 1698 nt, Artificial Sequence; identical to SEQ ID NO: 987
  derived and/or modified CDS sequence (AUadapt) from InfluenzaA__ABD77950__HA

SEQ ID NO: 1035 - RNA, 1698 nt, Artificial Sequence; identical to SEQ ID NO: 986
  derived and/or modified CDS sequence (AUadapt) from InfluenzaA__ABD77961__HA

SEQ ID NO: 1036 - RNA, 1698 nt, Artificial Sequence; identical to SEQ ID NO: 987
  derived and/or modified CDS sequence (AUadapt) from InfluenzaA__ABD77983__HA

SEQ ID NO: 1037 - RNA, 1698 nt, Artificial Sequence; identical to SEQ ID NO: 987
  derived and/or modified CDS sequence (AUadapt) from InfluenzaA__ABD77994__HA

SEQ ID NO: 1038 - RNA, 1698 nt, Artificial Sequence; identical to SEQ ID NO: 986
  derived and/or modified CDS sequence (AUadapt) from InfluenzaA__ABD78005__HA

SEQ ID NO: 1039 - RNA, 1698 nt, Artificial Sequence; identical to SEQ ID NO: 986
  derived and/or modified CDS sequence (AUadapt) from InfluenzaA__ABD78016__HA

SEQ ID NO: 1040 - RNA, 1698 nt, Artificial Sequence; identical to SEQ ID NO: 987
  derived and/or modified CDS sequence (AUadapt) from InfluenzaA__ABD78027__HA

SEQ ID NO: 1041 - RNA, 1698 nt, Artificial Sequence; identical to SEQ ID NO: 987
  derived and/or modified CDS sequence (AUadapt) from InfluenzaA__ABD78038__HA

SEQ ID NO: 1042 - RNA, 1701 nt, Artificial Sequence; identical to SEQ ID NO: 1022
  derived and/or modified CDS sequence (AUadapt) from InfluenzaA__ABD78049__HA

SEQ ID NO: 1043 - RNA, 1698 nt, Artificial Sequence; identical to SEQ ID NO: 541
  derived and/or modified CDS sequence (AUadapt) from InfluenzaA__ABD78060__HA

SEQ ID NO: 1044 - RNA, 1698 nt, Artificial Sequence
  derived and/or modified CDS sequence (AUadapt) from InfluenzaA__ABD78071__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucuccggcggcuucgggagcggcaucaucacguccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacucgaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacggcucccugcagugccggaucugcaucuga

SEQ ID NO: 1045 - RNA, 1698 nt, Artificial Sequence
  derived and/or modified CDS sequence (AUadapt) from InfluenzaA__ABD78093__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1046 - RNA, 1701 nt, Artificial Sequence
  derived and/or modified CDS sequence (AUadapt) from InfluenzaA__ABD78115__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccgacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccuccugaucaacuccaccgggaaccugaucgcgccccggggcuacuucaagauccgcucgggcaaguccagcaucaugcgguccgacgccccgaucgggaacugcaacucggagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucucggagguggaggggcgcauccaggaccuggagaaguacguggaggacacgaagaucgaccucugguccuacaacgccgagcugcuggucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcaacgaggcccugaacaaccgguuccagaucaagggcgucgagcucaagucgggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 1047 - RNA, 1701 nt, Artificial Sequence
  derived and/or modified CDS sequence (AUadapt) from InfluenzaA__ABD78126__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccgacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugagcacgaagcggucgcagcagaccgugaucccgaacaucggcucccgccccuggguccgcggggugagcuccaucaucucgaucuacuggaccaucgugaagcccggcgacauccuccugaucaacuccaccgggaaccugaucgcgccccggggcuacuucaagauccggagcggcaaguccucgaucaugcgcuccgacgccccgaucgggaacugcaacagcgagugcaucacgcccaacggcuccauccccaacgacaagcccuuccagaacgucaaccggaucaccuacggggccugcccgcgcuacgugaagcagaacacccucaagcuggccaccggcaugcggaacgugcccgagaagcagacgcgcgggaucuucggcgccaucgccggcuucaucgagaacgggugggagggcauggucgacgggugguacggcuuccggcaccagaacucggaggggaccggccaggccgccgaccugaaguccacccaggcggccaucaaccagaucaacggcaagcucaaccgccugaucgagaagaccaacgagaaguuccaccagaucgagaaggaguucagcgagguggaggggcggauccaggaccuggagaaguacguggaggacacgaagaucgaccucugguccuacaacgccgagcugcuggucgcccucgagaaccagcacaccaucgaccugaccgacucggagaugaacaagcuguucgagcgcacccggaagcagcuccgcgagaacgccgaggacaugggcaacgggugcuucaagaucuaccacaagugcgacaacgcgugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcugugcguggugcuccugggguucaucaugugggccugccagaagggcaacauccggugcaacaucugcaucuga

SEQ ID NO: 1048 - RNA, 1701 nt, Artificial Sequence
  derived and/or modified CDS sequence (AUadapt) from InfluenzaA__ABD79032__HA
augaagaccaucaucgcccugucguacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucucgaacugcuaccccuacgacgugccggacuacgccucccugcgcagccucgucgcguccagcgggacccuggaguucaucuccgagggcuucaccuggaccggggugacgcagaacggcgggucgaacgccugcaagcggggccccgacaucggcuucuucucccgccugaacuggcucuacaagagcggguccaccuaccccgugcugaacgucaccaugcccaacaacgacaacuucgacaagcuguacaucuggggcgugcaccacccgagcaccgaccaggagcagacgucccucuacgugcaggccucggggcgggucaccguguccaccaagcgcagccagcagaccaucauccccaacaucggcagccggcccugggugcgcggccuguccucgcggaucuccaucuacuggacgaucgucaagcccggggacauccuggugaucaacagcaacggcaaccucaucgccccgcgcggguacuucaagaugcggaccggcaaguccagcaucaugcgcuccgacgcgcccaucgggaccugcaucucggagugcaucacccccaacggcuccauccccaacgacaagccguuccagaacgugaacaagaucacguacggcgccugccccaaguacgucaagcagaacacccugaagcuggccaccgggaugcggaacgugcccgagaagcagacccgcggccucuucagcgccaucgccggguucaucgagaacggcugggaggggaugaucgacggcugguacggcuuccggcaccagaacuccgaggggacgggccaggcggccgaccucaagagcacccaggccgccaucgaccagaucaacgggaagcugaaccgcgugaucgagaagaccaacgagaaguuccaccagaucgagaaggaguucuccgaggucgagggccggauccaggaccucgagaaguacguggaggacaccaagaucgaccuguggucguacaacgccgagcugcucguggcgcuggagaaccagcacacgaucgaccugaccgacuccgagaugaacaagcuguucgagaagacccgccggcagcugcgcgagaacgccgaggacauggggaacggcugcuucaagaucuaccacaagugcgacaacgccugcaucggcagcauccggaacgggaccuacgaccacgacgucuaccgcgacgaggcccugaacaaccgcuuccagaucaagggcguggagcucaaguccggguacaaggacuggauccuguggaucagcuucgccaucuccugcuuccugcucugcgucgugcugcugggcuucaucaugugggcgugccagaagggcaacauccggugcaacaucugcaucuga

SEQ ID NO: 1049 - RNA, 1701 nt, Artificial Sequence
  derived and/or modified CDS sequence (AUadapt) from InfluenzaA__ABD79112__HA
augaaggccaagcugcucauccugcugugcgcccucucggcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagucgcuccuguccaagcggagcugguccuacaucgccgagacccccaacucggagaacggcgccugcuaccccggcgacuucgccgacuacgaggagcugcgcgagcagcucuccagcguguccucguucgagcgguucgagaucuuccccaaggggcgcuccuggccggagcacaacaucgacaucggcgugaccgccgcgugcagccacgccgggaaguccucguucuacaagaaccugcuguggcucaccgagaaggacggcuccuaccccaaccugaacaagagcuacgucaacaagaaggagaaggaggugcugauccucuggggcgugcaccacccgcccaacaucgagaaccagaagacgcuguaccggaaggagaacgccuacgucuccguggugucgagcaacuacaaccgccgguucacccccgagaucgccgagcgccccaagguccgggggcaggccggccgcaucaacuacuacuggacccugcucgagcccggggacaccaucaucuucgaggcgaacggcaaccugaucgcccccugguacgccuucgcccugaaccgggggaucggcuccggcaucaucacgucgaacgccuccauggacgagugcgacaccaagugccagaccccgcagggggcgaucaacagcucccuccccuuccagaacauccaccccuucaccaucggcgagugccccaaguacgugcgcucgacgaagcugcggauggugaccgggcugcgcaacaucccguccauccagagccggggccucuucggggccaucgccggcuucaucgagggcgggugggacggcaugaucgacgggugguacggcuaccaccaccagaacgagcagggguccggcuacgccgccgaccagaaguccacccagaacgcgaucaacggcaucaccaacaaggucaacucggugaucgagaagaugaacacgcaguucaccgccguggggaaggaguucaacaagcuggagaagcgcauggagaaccugaacaagaaggucgacgacggcuuccucgacaucuggaccuacaacgccgagcugcuggugcuccuggagaacgagcggacccuggacuuccacgacagcaacgugaagaaccucuacgagaaggucaagaaccagcugcgcaacaacgccaaggagaucgggaacggcugcuucgaguucuaccacaagugcaacaacgagugcauggaguccgugaagaacgggacguacgacuaccccaaguucucggaggaguccaagcugaaccgggagaagaucgacggcgugaagcucgagagcaugggcgucuaccagauccuggccaucuacuccaccguggcgucgucccugguccuccuggugagccugggggccaucucguucuggaugugcuccaacggcagccuccagugccgcaucugcaucuga

SEQ ID NO: 1050 - RNA, 1701 nt, Artificial Sequence
  derived and/or modified CDS sequence (AUadapt) from InfluenzaA__ABD79123__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcaagaacugcacccugaucgacgcccuccugggggacccccacugcgacggcuuccagaacaaggagugggaccuguucguggagcggucgacggccuacuccaacugcuaccccuacgacgugccggacuacgcgagccuccgcucccuggucgccucguccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgggucacggugucgaccaagcgcagccagcagaccgugaucccgaacaucggcucccggcccuggguccgcggggugucgucccggaucagcaucuacuggaccaucgugaagcccggcgacauccuccugaucaacuccacggggaaccugaucgcgccccgcggcuacuucaagauccggucgggcaaguccagcaucaugcgcuccgacgccccgaucgacaacugcaacucggagugcaucacccccaacggguccaucagcaacgacaagcccuuccagaacgucaaccggaucaccuacggcgccugcccccgcuacgugaagcagaacacccucaagcuggccacggggaugcggaacgugccggagaagcagacccgcggcaucuucggggccaucgccggcuucaucgagaacggcugggaggggauggucgacggcugguacggguuccggcaccagaacuccgagggcaccgggcaggccgccgaccucaagucgacccaggcggccaucaaccagaucaacggcaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgcggaagcagcuccgcgagaacgccgaggacauggggaacggcugcuuccgcaucuaccacaagugcgacaacgcgugcaucgggucgauccggaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcguggugcuccugggcuucaucaugugggccugccagaaggggaacauccgcugcaacaucugcaucuga

SEQ ID NO: 1051 - RNA, 1701 nt, Artificial Sequence
  derived and/or modified CDS sequence (AUadapt) from InfluenzaA__ABD79134__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcaagaacugcacccugaucgacgcccuccugggggacccccacugcgacggcuuccagaacaagaagugggaccuguucguggagcggucgacggccuacuccaacugcuaccccuacgacgugccggacuacgcgagccuccgcucccuggucgccucguccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgggucacggugucgaccaagcgcagccagcagaccgugaucccgaacaucggcucccggcccuggguccgcggggugucgucccggaucagcaucuacuggaccaucgugaagcccggcgacauccuccugaucaacuccacggggaaccugaucgcgccccgcggcuacuucaagauccggucgggcaaguccagcaucaugcgcuccgacgccccgaucgacaacugcaacucggagugcaucacccccaacggguccaucagcaacgacaagcccuuccagaacgucaaccggaucaccuacggcgccugcccccgcuacgugaagcagaacacccucaagcuggccacggggaugcggaacgugccggagaagcagacccgcggcaucuucggggccaucgccggcuucaucgagaacggcugggaggggauggucgacggcugguacggguuccggcaccagaacuccgagggcaccgggcaggccgccgaccucaagucgacccaggcggccaucaaccagaucaacggcaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgcggaagcagcuccgcgagaacgccgaggacauggggaacggcugcuucaagaucuaccacaagugcgacaacgcgugcaucgggucgauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcguggugcuccugggcuucaucaugugggccugccagaaggggaacauccggugcaacaucugcaucuga

SEQ ID NO: 1052 - RNA, 1701 nt, Artificial Sequence
  derived and/or modified CDS sequence (AUadapt) from InfluenzaA__ABD79145__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcaagaacugcacccugaucgacgcccuccugggggacccccacugcgacggcuuccagaacaaggagugggaccuguucguggagcggucgacggccuacuccaacugcuaccccuacgacgugccggacuacgcgagccuccgcucccuggucgccucguccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgggucacggugucgaccaagcgcagccagcagaccgugaucccgaacaucggcucccggcccuggguccgcggggugucgucccggaucagcaucuacuggaccaucgugaagcccggcgacauccuccugaucaacuccacggggaaccugaucgcgccccgcggcuacuucaagauccggucgggcaaguccagcaucaugcgcuccgacgccccgaucgacaacugcaacucggagugcaucacccccaacggguccaucagcaacgacaagcccuuccagaacgucaaccggaucaccuacggcgccugcccccgcuacgugaagcagaacacccucaagcuggccacggggaugcggaacgugccggagaagcagacccgcggcaucuucggggccaucgccggcuucaucgagaacggcugggaggggauggucgacggcugguacggguuccggcaccagaacuccgagggcaccgggcaggccgccgaccucaagucgacccaggcggccaucaaccagaucaacggcaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgcggaagcagcuccgcgagaacgccgaggacauggggaacggcugcuucaagaucuaccacaagugcgacaacgcgugcaucgggucgauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcguggugcuccugggcuucaucaugugggccugccagaaggggaacauccggugcaacaucugcaucuga

SEQ ID NO: 1053 - RNA, 1701 nt, Artificial Sequence; identical to SEQ ID NO: 1052
  derived and/or modified CDS sequence (AUadapt) from InfluenzaA__ABD79156__HA

SEQ ID NO: 1054 - RNA, 1701 nt, Artificial Sequence; identical to SEQ ID NO: 268
  derived and/or modified CDS sequence (AUadapt) from InfluenzaA__ABD79167__HA

SEQ ID NO: 1055 - RNA, 1701 nt, Artificial Sequence; identical to SEQ ID NO: 1052
  derived and/or modified CDS sequence (AUadapt) from InfluenzaA__ABD79178__HA

SEQ ID NO: 1056 - RNA, 1701 nt, Artificial Sequence
  derived and/or modified CDS sequence (AUadapt) from InfluenzaA__ABD79189__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcaagaacugcacccugaucgacgcccuccugggggacccccacugcgacggcuuccagaacaaggagugggaccuguucguggagcggucgacggccuacuccaacugcuaccccuacgacgugccggacuacgcgagccuccgcucccuggucgccucguccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccucgcuguacgugcaggccuccgggcgggucacggugagcaccaagcgcucgcagcagaccgugaucccgaacaucggcucccggcccuggguccgcggggugagcucccggaucucgaucuacuggaccguggucaagcccggcgacauccuccugaucaacuccacggggaaccugaucgcgccccgcggcuacuucaagauccggagcggcaaguccagcaucaugcgcuccgacgccccgaucgacucgugcaacuccgagugcaucacccccaacgggagcaucuccaacgacaagcccuuccagaacgugaaccggaucaccuacggcgccugcccccgcuacgugaagcagaacacccucaagcuggccacggggaugcggaacgucccggagaagcagacccgcggcaucuucggggccaucgccggcuucaucgagaacggcugggaggggaugguggacggcugguacggguuccggcaccagaacucggagggcaccgggcaggccgccgaccugaaguccacccaggcggccaucaaccagaucaacggcaagcucaaccgccugaucgagaagacgaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugaccgacucggagaugaacaagcuguucgagcgcacgcggaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucagcuucgccaucuccugcuuccugcugugcgugguccuccugggcuucaucaugugggccugccagaaggggaacauccggugcaacaucugcaucuga

SEQ ID NO: 1057 - RNA, 1701 nt, Artificial Sequence; identical to SEQ ID NO: 1052
  derived and/or modified CDS sequence (AUadapt) from InfluenzaA__ABD79200__HA

SEQ ID NO: 1058 - RNA, 1701 nt, Artificial Sequence
  derived and/or modified CDS sequence (AUadapt) from InfluenzaA__ABD79211__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcaagaacugcacccugaucgacgcccuccugggggacccccacugcgacggcuuccagaacaaggagugggaccuguucguggagcggucgacggccuacuccaacugcuaccccuacgacgugccggacuacgcgagccuccgcucccuggucgccucguccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgggucacggugucgaccaagcgcagccagcagaccgugaucccgaacaucggcucccggcccuggauccgcggggucucgucccggaucagcaucuacuggaccaucgugaagcccggcgacauccuccugaucaacuccacggggaaccugaucgcgccccgcggcuacuucaagauccggucgggcaaguccagcaucaugcgcuccgacgccccgaucgacaacugcaacucggagugcaucacccccaacggguccaucagcaacgacaagcccuuccagaacgugaaccggaucaccuacggcgccugcccccgcuacgucaagcagaacacccucaagcuggccacggggaugcggaacgugccggagaagcagacccgcggcaucuucggggccaucgccggcuucaucgagaacggcugggaggggaugguggacggcugguacggguuccggcaccagaacuccgagggcaccgggcaggccgccgaccucaagucgacccaggcggccaucaaccagaucaacggcaagcugaaccgccugaucgagaagacgaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugaccgacuccgagaugaacaagcuguucgagcgcacgcggaagcagcuccgcgagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaaggggguggagcugaaguccggcuacaaggacuggauccucuggaucagcuucgccaucagcugcuuccugcugugcgucgugcuccugggcuucaucaugugggccugccagaaggggaacauccggugcaacaucugcaucuga

SEQ ID NO: 1059 - RNA, 1701 nt, Artificial Sequence; identical to SEQ ID NO: 268
  derived and/or modified CDS sequence (AUadapt) from InfluenzaA__ABD79222__HA

SEQ ID NO: 1060 - RNA, 1701 nt, Artificial Sequence; identical to SEQ ID NO: 268
  derived and/or modified CDS sequence (AUadapt) from InfluenzaA__ABD79233__HA

SEQ ID NO: 1061 - RNA, 1701 nt, Artificial Sequence
  derived and/or modified CDS sequence (AUadapt) from InfluenzaA__ABD79244__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcaagaacugcacccugaucgacgcccuccugggggacccccacugcgacggcuucaagaacaaggagugggaccuguucguggagcggucgacggccuacuccaacugcuaccccuacgacgugccggacuacgcgagccuccgcucccuggucgccucguccggcacccuggaguucaccaacgagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgggucacggugucgaccaagcgcagccagcagaccgugaucccgaacaucggcucccggcccuggguccgcggggugucgucccggaucagcaucuacuggaccaucgugaagcccggcgacauccuccugaucaacuccacggggaaccugaucgcgccccgcggcuacuucaagauccggucgggcaaguccagcaucaugcgcuccgacgccccgaucgacaacugcaacucggagugcaucacccccaacggguccauccccaacgacaagcccuuccagaacgucaaccggaucaccuacggcgccugcccgcgcuacgugaagcagaacacccucaagcuggccacggggaugcggaacgugcccgagaagcagacccgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcucaaccgccugaucgagaagacgaacgagaaguuccaccagaucgagaaggaguucucggagguggagggccggauccaggaccuggagaaguacguggaggacaccaagaucgaccucugguccuacaacgccgagcugcuggucgcccucgagaaccagcacaccaucgaccugaccgacagcgagaugaacaagcuguucgagcgcacgcggaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagucgggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 1062 - RNA, 1701 nt, Artificial Sequence; identical to SEQ ID NO: 488
  derived and/or modified CDS sequence (AUadapt) from InfluenzaA__ABD94734__HA

SEQ ID NO: 1063 - RNA, 1701 nt, Artificial Sequence; identical to SEQ ID NO: 875
  derived and/or modified CDS sequence (AUadapt) from InfluenzaA__ABD94745__HA

SEQ ID NO: 1064 - RNA, 1701 nt, Artificial Sequence
  derived and/or modified CDS sequence (AUadapt) from InfluenzaA__ABD94767__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgacaacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggaccagaacgggaccuccucggccugcaagcggcgcuccaacaagagcuucuucucccggcucaacuggcugcaccagcugaaguacaaguaccccgcccucaacgucacgaugcccaacaacgagaaguucgacaagcuguacaucuggggcgugcaccaccccucgaccgacuccgaccagaucagccuguacgcgcaggccucggggcgcgugaccgucuccaccaagcggagccagcagaacgugaucccgaacaucggcucccgccccugggugcgcggggucucgucccggaucagcaucuacuggacgaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacgggugggagggcaugguggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 1065 - RNA, 1698 nt, Artificial Sequence; identical to SEQ ID NO: 1045
  derived and/or modified CDS sequence (AUadapt) from InfluenzaA__ABD94778__HA

SEQ ID NO: 1066 - RNA, 1698 nt, Artificial Sequence; identical to SEQ ID NO: 1045
  derived and/or modified CDS sequence (AUadapt) from InfluenzaA__ABD94789__HA

SEQ ID NO: 1067 - RNA, 1701 nt, Artificial Sequence
  derived and/or modified CDS sequence (AUadapt) from InfluenzaA__ABD94822__HA
augaagaccaucaucgcccugucguacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcgagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaacaacgagagcuucaacuggaccgggguggcccagaacggcaccuccuacgccugcaagcgcucguccaucaagagcuucuucucccggcugaacuggcuccaccagcugaaguacaaguaccccgcgcugaacgugaccaugcccaacaacgacaaguucgacaagcucuacaucuggggcguccaccaccccucgacggacuccgaccagaccagccuguacgcccaggccucggggcgcgugaccguguccaccaagcggagccagcagacggucaucccgaacaucgggucccgccccugggugcggggcgugucgucccgcaucagcaucuacuggaccaucgucaagcccggcgacauccugcucaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcugaaccggcucaucgagaagaccaacgagaaguuccaccagaucgagaaggaguucucggagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagcggacccgcaagcagcugcgcgagaacgcggaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcugaaguccggguacaaggacuggauccuguggaucagcuucgccaucuccugcuuccuccugugcgugguccugcucggcuucaucaugugggccugccagaagggcaacauccgcugcaacaucugcaucuga

SEQ ID NO: 1068 - RNA, 1701 nt, Artificial Sequence
  derived and/or modified CDS sequence (AUadapt) from InfluenzaA__ABD94833__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccgacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccuccugaucaacuccaccgggaaccugaucgcgccccggggcuacuucaagauccgcucgggcaaguccagcaucaugcgguccgacgccccgaucgggaacugcaacucggagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucucggagguggaggggcgcauccaggaccuggagaaguacguggaggacacgaagaucgaccucugguccuacaacgccgagcugcuggucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagucgggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 1069 - RNA, 1701 nt, Artificial Sequence
  derived and/or modified CDS sequence (AUadapt) from InfluenzaA__ABD94844__HA
augaagaccaucaucgcccugucguacauccucugcaugguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaacaacgagagcuucaacuggaccgggguggcccagaacggcaccuccuacgccugcaagcgccggagcgugaaguccuucuucucgcgccugaacuggcuccacaagcuggaguacaaguaccccgcgcugaacgucaccaugcccaacaacgacaaguucgacaagcucuacaucuggggcgugcaccaccccuccacggacagcgaccagaccucccuguacgugcaggccucggggcgggucaccgugagcaccaagcgcucccagcagacggugaucccgaacaucgggucgcggcccuggguccgcggcguguccagcaucaucuccaucuacuggaccaucgugaagcccggcgacauccugcucaucaacagcaccgggaaccugaucgcgccccggggcuacuucaagauccgcuccgggaaguccuccaucaugcggucggacgccccgaucggcaacugcaacuccgagugcaucacccccaacggcagcauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgccgaccucaagucgacccaggcggccaucaaccagaucaacgggaagcugaaccggcugaucgagaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggacccgcaagcagcugcgcgagaacgccgaggacaugggcaacgggugcuucaagaucuaccacaagugcgacaacgcgugcaucggcucgauccggaacgggaccuacgaccacgacguguaccgcgacgaggcccucaacaaccgguuccagaucaagggcgucgagcugaaguccggguacaaggacuggauccuguggaucagcuucgccaucagcugcuuccuccugugcguggugcugcucggcuucaucaugugggccugccagaagggcaacauccgcugcaacaucugcaucuga

SEQ ID NO: 1070 - RNA, 1701 nt, Artificial Sequence
  derived and/or modified CDS sequence (AUadapt) from InfluenzaA__ABD94855__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggagcuccaccggccgcaucugcgacucgccccaccggauccuggacgggaagaacugcacccugaucgacgcccuccugggcgacccccacugcgacggcuuccagaacaaggagugggaccuguucguggagcgcuccaaggccuacagcaacugcuaccccuacgacgugccggacuacgcgucccuccggucgcuggucgccuccagcgggacgcuggaguucaacaacgaguccuucaacuggaccggcguggcccagaacgggaccucguacgccugcaagcgcggcuccgucaagagcuucuucucccggcucaacuggcugcacaagcuggaguacaaguaccccgcgcucaacgugaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgcggggugucgucccggaucagcaucuacuggaccaucgugaagcccggcgacauccuccugaucaacuccaccgggaaccugaucgcgccccggggcuacuucaagauccgcucgggcaaguccagcaucaugcgguccgacgccccgaucgacaacugcaacucggagugcaucacccccaacggguccauccccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacggcugggaggggauggucgacggcugguacggguuccgccaccagaacagcgagggcacggggcaggccgccgaccugaaguccacccaggcggccaucaaccagaucaacggcaagcucaaccggcugaucgagaagaccaacgagaaguuccaccagaucgagaaggaguucucggagguggagggccgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagucgggcuacaaggacuggauccuguggaucuccuucgccaucagcugcuuccugcugugcguggugcuccugggcuucaucaugugggccugccagaaggggaacauccgcugcaacaucugcaucuga

SEQ ID NO: 1071 - RNA, 1701 nt, Artificial Sequence
  derived and/or modified CDS sequence (AUadapt) from InfluenzaA__ABD94866__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacggcccccaccagauccucgacgggaagaacugcacccugaucgacgcccugcucggcgacccccacugcgacggcuuccagaacaaggagugggaccuguucguggagcggucgaaggccuacuccaacugcuaccccuacgacgugccggacuacgcgagccugcgcucccucgucgccucguccgggacgcuggaguucaccaacgagagcuucaacuggaccggcguggcccagaacgggaccuccuacgccugcaagcggggcucggugaaguccuucuucucgcgccugaacuggcuccacaagcuggaguacaaguaccccgcgcugaacgucacgaugcccaacaacgacaaguucgacaagcucuacaucuggggcgugcaccaccccuccaccgacagcgaccagaccucccuguacgugcagucgagcgggcggaucaccgucuccacgaagcgcucgcagcagaccgugaccccgaacaucggcucccggcccugggugcgcggggucagcucccggaucucgaucuacuggaccaucgugaagcccggcgacauccugcucaucacguccaccgggaaccugaucgcgccccgcggcuacuucaagauccggcgcggcaagucguccaucaugcggagcgacgccccgaucgacaacugcaacuccgagugcaucacccccaacgggucgauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacgcaggccgcgaucaaccagaucaacggcaagcugaaccggcugaucgagaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacaccaucgaccucacggacuccgagaugaacaagcuguucgagcggacccgcaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaaggggguggagcugaaguccggcuacaaggacuggauccuguggaucucguucgccaucagcugcuuccuccugugcgucgugcugcucggcuucaucaugugggccugccagaaggggaacauccgcugcaacaucugcaucuga

SEQ ID NO: 1072 - RNA, 1701 nt, Artificial Sequence
  derived and/or modified CDS sequence (AUadapt) from InfluenzaA__ABD94877__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaacaacgagagcuucaacuggaccgggguggcccagaacggcaccuccuacgccugcaagcgccggucggugaaguccuucuucagccgccucaacuggcugcacaagcuggaguacaaguaccccgcgcucaacgucaccaugcccaacaacgacaaguucgacaagcuguacaucuggggcgugcaccaccccuccacggacucggaccagaccucccuguacgugcaggccagcgggcgggucaccgugucgaccaagcgcucccagcagacggugaucccgaacaucgggagccggcccuggguccgcggcguguccucgcggaucuccaucuacuggaccaucgugaagcccggcgacauccuccugaucaacagcaccgggaaccugaucgcgccccgcggcuacuucaagauccgguccgggaaguccuccaucaugcgcucggacgccccgaucgacaacugcaacuccgagugcaucacccccaacggcagcauccccaacgacaagcccuuccagaacgucaaccggaucacguacggcgccugcccgcgcuacgugaagcagaacacccucaagcuggccaccgggaugcggaacgugcccgagaagcagacccgcggcaucuucggggccaucgccggcuucaucgagaacgggugggagggcauggucgacggcugguacggguuccggcaccagaacuccgagggcacggggcaggccgccgaccucaagucgacccaggcggccaucaaccagaucaacggcaagcugaaccgccugaucgagaagaccaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacacgaucgaccugaccgacuccgagaugaacaagcuguucgagcgcacccgcaagcagcuccgggagaacgccgaggacaugggcaacggcugcuucaagaucuaccacaagugcgacaacgcgugcaucgggucgauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcguggugcuccugggguucaucaugugggccugccagaagggcaacauccggugcaacaucugcaucuga

SEQ ID NO: 1073 - RNA, 1701 nt, Artificial Sequence
  derived and/or modified CDS sequence (AUadapt) from InfluenzaA__ABD94888__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuucaagaacaaggagugggaccuguucguggagcgcucgacggccuacuccaacugcuaccccuacgacgugccggacuacgcgagccuccggucccuggucgccucguccggcacccuggaguucaccaacgagggguucaacuggaccggcguggcccaggacgggacgagcuacgccugcaagcgcggcuccgugaaguccuucuucucccggcucaacuggcugcacaagcuggaguacaaguaccccgcgcucaacgucaccaugcccaacaacgacaaguucgacaagcuguacaucuggggcgugcaccaccccucgaccgacuccgaccagaccagccuguacgugcaggccuccgggcgcgucacggugucgaccaagcggagccagcagaccgugaucccgaacaucggcucccgccccuggguccgcggggugucgucccggaucagcaucuacuggaccaucgugaagcccggcgacauccuccugaucaacuccacggggaaccugaucgcgccccggggcuacuucaagauccgcucgggcaaguccagcaucaugcgguccgacgccccgaucgacaacugcaacucggagugcaucacccccaacggguccauccccaacgacaagcccuuccagaacgucaaccgcaucaccuacggcgccugcccgcgguacgugaagcagaacacccucaagcuggccacggggaugcgcaacgugcccgagaagcagacccggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcucaaccggcugaucgagaagacgaacgagaaguuccaccagaucgagaaggaguucucggagguggagggccgcauccaggaccuggagaaguacguggaggacaccaagaucgaccucugguccuacaacgccgagcugcuggucgcccucgagaaccagcacaccaucgaccugaccgacagcgagaugaacaagcuguucgagcggacgcgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagucgggcuacaaggacuggauccuguggaucuccuucgccaucagcugcuuccugcugugcguggugcuccugggcuucaucaugugggccugccagaaggggaacauccgcugcaacaucugcaucuga

SEQ ID NO: 1074 - RNA, 1701 nt, Artificial Sequence; identical to SEQ ID NO: 1052
  derived and/or modified CDS sequence (AUadapt) from InfluenzaA__ABD94899__HA

SEQ ID NO: 1075 - RNA, 1701 nt, Artificial Sequence
  derived and/or modified CDS sequence (AUadapt) from InfluenzaA__ABD94910__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggucgcuggucgccuccagcggcacgcuggaguucaacaacgaguccuucaacuggaccgggguggcccagaacggcaccucguacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccucgacggacuccgaccagaccagccuguacgugcaggccuccgggcgggucaccgugucgaccaagcgcagccagcagacggugaucccgaacaucgggucccggcccuggguccgcggcgugucgucccggaucagcaucuacuggaccaucgugaagcccggcgacauccuccugaucaacuccaccgggaaccugaucgcgccccgcggcuacuucaagauccggucggggaaguccagcaucaugcgcuccgacgccccgaucggcaacugcaacucggagugcaucacccccaacggcuccauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggguucaucgagaacggcugggagggcauggucgacgggugguacggcuuccggcaccagaacagcgaggggacgggccaggccgccgaccugaaguccacccaggcggccaucaaccagaucaacgggaagcucaaccgccugaucgagaagaccaacgagaaguuccaccagaucgagaaggaguucucggagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccgcaagcagcuccgggagaacgccgaggacaugggcaacgggugcuuccgcaucuaccacaagugcgacaacgcgugcaucggcuccauccggaacgggaccuacgaccacgacguguaccgcgacgaggcccugaacaaccgguuccagaucaagggcgucgagcucaagucgggguacaaggacuggauccuguggaucuccuucgccaucagcugcuuccugcugugcguggugcuccugggcuucaucaugugggccugccagaagggcaacauccgcugcaacaucugcaucuga

SEQ ID NO: 1076 - RNA, 1701 nt, Artificial Sequence
  derived and/or modified CDS sequence (AUadapt) from InfluenzaA__ABD94921__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacggcccccaccagauccuggacgggaagaacugcacccugaucgacgcccuccugggcgacccccacugcgacggcuuccagaacaaggagugggaccuguucguggagcgguccaaggccuacucgaacugcuaccccuacgacgugccggacuacgcgucccuccgcagccuggucgccuccucggggacgcuggaguucaccaacgaguccuucaacuggaccggcguggcccagaacgggaccagcuacgccugcaagcggggcuccgucaagucguucuucucccgccucaacuggcugcacaagcuggaguacaaguaccccgcgcucaacgugacgaugcccaacaacgacaaguucgacaagcuguacaucuggggcgugcaccaccccagcaccgacuccgaccagaccucgcuguacgugcaguccagcgggcgggucaccgugucgacgaagcgcucccagcagaccgugaccccgaacaucggcucgcggcccuggguccgcgggguguccagccggaucuccaucuacuggaccaucgugaagcccggcgacauccuccugaucaacucgacggggaaccugaucgcgccccgcggcuacuucaagauccggcgcggcaaguccagcaucaugcgguccgacgccccgaucgacaacugcaacucggagugcaucacccccaacggguccauccccaacgacaagcccuuccagaacgucaaccgcaucaccuacggcgccugcccgcgguacgugaagcagaacacccucaagcuggccacggggaugcgcaacgugcccgagaagcagacccggggcaucuucggggccaucgccggcuucaucgagaacggcugggaggggauggucgacggcugguacggguuccgccaccagaacagcgagggcaccgggcaggccgccgaccugaaguccacccaggccgcgaucaaccagaucaacggcaagcucaaccggcugaucgagaagacgaacgagaaguuccaccagaucgagaaggaguucucggagguggagggccgcauccaggaccuggagaaguacguggaggacaccaagaucgaccucugguccuacaacgccgagcugcuggucgcccucgagaaccagcacaccaucgaccugaccgacagcgagaugaacaagcuguucgagcggacgcgcaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaagggggucgagcucaagucgggcuacaaggacuggauccuguggaucuccuucgccaucagcugcuuccugcugugcguggugcuccugggcuucaucaugugggccugccagaaggggaacauccgcugcaacaucugcaucuga

SEQ ID NO: 1077 - RNA, 1701 nt, Artificial Sequence; identical to SEQ ID NO: 1052
  derived and/or modified CDS sequence (AUadapt) from InfluenzaA__ABD94932__HA

SEQ ID NO: 1078 - RNA, 1698 nt, Artificial Sequence
  derived and/or modified CDS sequence (AUadapt) from InfluenzaA__ABD94943__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaagaagaaggaggugcucauccuguggggcgugcaccacccgcccaacaucggggaccagcggacccuguaccacacggagaacgccuacgucucgguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagucgaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 1079 - RNA, 1701 nt, Artificial Sequence; identical to SEQ ID NO: 878
  derived and/or modified CDS sequence (AUadapt) from InfluenzaA__ABD94954__HA

SEQ ID NO: 1080 - RNA, 1698 nt, Artificial Sequence; identical to SEQ ID NO: 987
  derived and/or modified CDS sequence (AUadapt) from InfluenzaA__ABD94965__HA

SEQ ID NO: 1081 - RNA, 1698 nt, Artificial Sequence; identical to SEQ ID NO: 986
  derived and/or modified CDS sequence (AUadapt) from InfluenzaA__ABD94987__HA

SEQ ID NO: 1082 - RNA, 1698 nt, Artificial Sequence; identical to SEQ ID NO: 986
  derived and/or modified CDS sequence (AUadapt) from InfluenzaA__ABD94998__HA

SEQ ID NO: 1083 - RNA, 1698 nt, Artificial Sequence; identical to SEQ ID NO: 986
  derived and/or modified CDS sequence (AUadapt) from InfluenzaA__ABD95009__HA

SEQ ID NO: 1084 - RNA, 1698 nt, Artificial Sequence; identical to SEQ ID NO: 987
  derived and/or modified CDS sequence (AUadapt) from InfluenzaA__ABD95020__HA

SEQ ID NO: 1085 - RNA, 1698 nt, Artificial Sequence
  derived and/or modified CDS sequence (AUadapt) from InfluenzaA__ABD95031__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucaccgacuacgaggagcugcgcgagcagcucuccagcguguccagcuucgagcgguucgagaucuucccgaaggaguccagcuggcccaaccacaccgucaccgggguguccgccucgugcucccacaacggcaagagcuccuucuaccgcaaccugcuguggcucacggggaagaacggccuguaccccaaccugcggcgcagcuacgccaacaacaaggagaaggaggugcucguccuguggggcgugcaccacccgcccaacaucggggaccagaaggcccuguaccacaccgagaacgccuacguguccgucgugucgagccacuacucccggcgcuucacccccgagaucgccaagcggcccaaggugcgcggccaggaggggcggaucaacuacuacuggacccuccuggagcccggcgacacgaucaucuucgaggccaacgggaaccugaucgcgccgcgcuacgccuucgcccucagccggggcuucggcuccgggaucaucaccagcaacgcccccauggacgagugcgacgccaagugccagacgccccagggcgcgaucaacuccucgcugcccuuccagaacguccacccggugaccaucggggagugccccaaguacgugcgcuccgccaagcugcggauggucaccggccuccgcaacauccccagcauccagucccgggggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacucgaucaucgagaagaugaacacgcaguucaccgccgucggcaaggaguucaacaagcuggagcgccggauggagaaccucaacaagaagguggacgacggguuccuggacaucuggaccuacaacgccgagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacaacgagugcauggaguccgugaagaacggcacguacgacuaccccaaguacagcgaggaguccaagcucaaccgggagaagaucgacggcgugaagcuggagagcauggggguguaccagauccuggcgaucuacuccaccgucgccucgagccucgugcugcuggugucccucggcgccaucagcuucuggaugugcuccaacgggagccugcagugccgcaucugcaucuga

SEQ ID NO: 1086 - RNA, 1698 nt, Artificial Sequence
  derived and/or modified CDS sequence (AUadapt) from InfluenzaA__ABD95042__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaagggcaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggcuucgggagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccggggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacggcucccugcagugccgcaucugcaucuga

SEQ ID NO: 1087 - RNA, 1698 nt, Artificial Sequence; identical to SEQ ID NO: 1086
  derived and/or modified CDS sequence (AUadapt) from InfluenzaA__ABD95053__HA

SEQ ID NO: 1088 - RNA, 1698 nt, Artificial Sequence; identical to SEQ ID NO: 1045
  derived and/or modified CDS sequence (AUadapt) from InfluenzaA__ABD95064__HA

SEQ ID NO: 1089 - RNA, 1698 nt, Artificial Sequence
  derived and/or modified CDS sequence (AUadapt) from InfluenzaA__ABD95075__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucuccaagggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgcgagaagaucgacggggugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 1090 - RNA, 1698 nt, Artificial Sequence; identical to SEQ ID NO: 1086
  derived and/or modified CDS sequence (AUadapt) from InfluenzaA__ABD95086__HA

SEQ ID NO: 1091 - RNA, 1698 nt, Artificial Sequence; identical to SEQ ID NO: 1045
  derived and/or modified CDS sequence (AUadapt) from InfluenzaA__ABD95097__HA

SEQ ID NO: 1092 - RNA, 1698 nt, Artificial Sequence
  derived and/or modified CDS sequence (AUadapt) from InfluenzaA__ABD95119__HA
augaaggccaagcugcucauccugcugugcaccuucaccgccacguacgcggacaccaucugcaucggcuaccacgccaacaacucgaccgacaccguggacacgguccucgagaagaacgugaccgugacccacuccgucaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcgucuccagcuucgagcgguucgagaucuucccgaagggguccucguggcccaaccacaccgugaccggcguguccgccagcugcucccacaacggcaagagcuccuucuaccgcaaccugcuguggcucaccgggaagaacgggcuguaccccaaccugagcauguccuacgucaacaacaaggagaaggaggugcucgugcuguggggcguccaccacccgcccaacaucggcgaccagcgggcccuguaccacacggagaacgccuacgugagcguggucagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggcgccaucgccggguucaucgagggcggguggaccggcauggucgacgggugguacggcuaccaccaccagaacgagcagggcuccggguacgcggccgaccagaaguccacccagaacgccaucaacggcaucaccaacaaggugaacagcgugaucgagaagaugaacacccaguucacggccgucgggaaggaguucaacaagcuggagcgccggauggagaaccucaacaagaagguggacgacggcuuccuggacaucuggaccuacaacgccgagcugcucguccugcuggagaacgagcgcacccucgacuuccacgacucgaacgugaagaaccuguacgagaaggugaagucccagcugaagaacaacgcgaaggagaucgggaacggcugcuucgaguucuaccacaagugcaacaacgagugcauggagagcgucaagaacggcaccuacgacuaccccaaguacuccgaggagagcaagcucaaccgggagaagaucgacggggugaagcuggaguccaugggcguguaccagauccuggccaucuacagcacggucgccagcucccucgugcugcuggugagccucggggccaucuccuucuggaugugcagcaacggcucccugcagugccgcaucugcaucuga

SEQ ID NO: 1093 - RNA, 1698 nt, Artificial Sequence
  derived and/or modified CDS sequence (AUadapt) from InfluenzaA__ABD95130__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaagggguccagcuggcccaaccacaccgugaccggcgucuccgccagcugcucccacaacggcaagagcuccuucuaccgcaaccugcuguggcucaccgggaagaacgggagcuaccccaaccuguccaugucguacgugaacaacaaggagaaggaggugcugguccucuggggcgugcaccacccgcccaacaucggcgaccagcgggcccuguaccacacggagaacgccuacgugagcgucguguccagccacuacucccgccgguucacccccgagaucgccaagcgccccaaggugcgggaccaggaggggcgcaucaacuacuacuggacccugcucgagcccggcgacaccaucaucuucgaggcgaacgggaaccugaucgccccgugguacgccuucgcccugagccggggcuucggcuccgggaucaucacgagcaacgcccccaugggcgagugcgacgcgaagugccagacgccccagggggccaucaacuccucgcuccccuuccagaacguccacccggugaccaucggcgagugccccaaguacgugcgcuccgccaagcugcggauggucaccgggcugcgcaacauccccagcauccagucccggggccucuucggcgccaucgccggguucaucgagggcggguggaccggcaugguggacgggugguacggcuaccaccaccagaacgagcagggcagcggguacgcggccgaccagaaguccacccagaacgccaucaacggcaucaccaacaaggugaacagcgucaucgagaagaugaacacccaguucacggccguggggaaggaguucaacaagcuggagcgccggauggagaaccugaacaagaaggucgacgacggcuuccucgacaucuggaccuacaacgccgagcugcuggugcuccuggagaacgagcgcacccuggacuuccacgacuccaacgugaagaaccucuacgagaaggucaagagccagcugaagaacaacgcgaaggagaucgggaacggcugcuucgaguucuaccacaagugcaacaacgagugcauggaguccgugaagaacggcaccuacgacuaccccaaguacucggaggaguccaagcugaaccgggagaagaucgacggggugaagcucgagagcaugggcgucuaccagauccuggccaucuacagcacgguggccuccagccuggugcuccuggucucccugggggccaucagcuucuggaugugcuccaacggcagccuccagugccgcaucugcaucuga

SEQ ID NO: 1094 - RNA, 1698 nt, Artificial Sequence; identical to SEQ ID NO: 1045
  derived and/or modified CDS sequence (AUadapt) from InfluenzaA__ABD95141__HA

SEQ ID NO: 1095 - RNA, 1698 nt, Artificial Sequence; identical to SEQ ID NO: 1045
  derived and/or modified CDS sequence (AUadapt) from InfluenzaA__ABD95152__HA

SEQ ID NO: 1096 - RNA, 1698 nt, Artificial Sequence; identical to SEQ ID NO: 1092
  derived and/or modified CDS sequence (AUadapt) from InfluenzaA__ABD95163__HA

SEQ ID NO: 1097 - RNA, 1698 nt, Artificial Sequence; identical to SEQ ID NO: 1086
  derived and/or modified CDS sequence (AUadapt) from InfluenzaA__ABD95174__HA

SEQ ID NO: 1098 - RNA, 1698 nt, Artificial Sequence
  derived and/or modified CDS sequence (AUadapt) from InfluenzaA__ABD95185__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggggagagcuccuucuaccgcaaccugcuguggcucaccggcaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1099 - RNA, 1698 nt, Artificial Sequence; identical to SEQ ID NO: 1086
  derived and/or modified CDS sequence (AUadapt) from InfluenzaA__ABD95196__HA

SEQ ID NO: 1100 - RNA, 1698 nt, Artificial Sequence; identical to SEQ ID NO: 544
  derived and/or modified CDS sequence (AUadapt) from InfluenzaA__ABD95207__HA

SEQ ID NO: 1101 - RNA, 1698 nt, Artificial Sequence; identical to SEQ ID NO: 1045
  derived and/or modified CDS sequence (AUadapt) from InfluenzaA__ABD95218__HA

SEQ ID NO: 1102 - RNA, 1698 nt, Artificial Sequence; identical to SEQ ID NO: 1092
  derived and/or modified CDS sequence (AUadapt) from InfluenzaA__ABD95229__HA

SEQ ID NO: 1103 - RNA, 1698 nt, Artificial Sequence; identical to SEQ ID NO: 1045
  derived and/or modified CDS sequence (AUadapt) from InfluenzaA__ABD95240__HA

SEQ ID NO: 1104 - RNA, 1698 nt, Artificial Sequence; identical to SEQ ID NO: 1086
  derived and/or modified CDS sequence (AUadapt) from InfluenzaA__ABD95251__HA

SEQ ID NO: 1105 - RNA, 1698 nt, Artificial Sequence; identical to SEQ ID NO: 544
  derived and/or modified CDS sequence (AUadapt) from InfluenzaA__ABD95262__HA

SEQ ID NO: 1106 - RNA, 1698 nt, Artificial Sequence; identical to SEQ ID NO: 1045
  derived and/or modified CDS sequence (AUadapt) from InfluenzaA__ABD95273__HA

SEQ ID NO: 1107 - RNA, 1698 nt, Artificial Sequence; identical to SEQ ID NO: 541
  derived and/or modified CDS sequence (AUadapt) from InfluenzaA__ABD95284__HA

SEQ ID NO: 1108 - RNA, 1698 nt, Artificial Sequence; identical to SEQ ID NO: 1045
  derived and/or modified CDS sequence (AUadapt) from InfluenzaA__ABD95295__HA

SEQ ID NO: 1109 - RNA, 1698 nt, Artificial Sequence
  derived and/or modified CDS sequence (AUadapt) from InfluenzaA__ABD95306__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggagauccucgugcuguggggcguccaccacccgcccaacaucggcgaccagcgggcccuguaccacacggagaacgccuacgugagcguggucagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggcgccaucgccggguucaucgagggcggguggaccggcauggucgacgggugguacggcuaccaccaccagaacgagcagggcuccggguacgcggccgaccagaaguccacccagaacgccaucaacggcaucaccaacaaggugaacagcgugaucgagaagaugaacacccaguucacggccgucgggaaggaguucaacaagcuggagcgccggauggagaaccucaacaagaagguggacgacggcuuccuggacaucuggaccuacaacgccgagcugcucguccugcuggagaacgagcgcacccucgacuuccacgacucgaacgugaagaaccuguacgagaaggugaagucccagcugaagaacaacgcgaaggagaucgggaacggcugcuucgaguucuaccacaagugcaacaacgagugcauggagagcgucaagaacggcaccuacgacuaccccaaguacuccgaggagagcaagcucaaccgggagaagaucgacggggugaagcuggaguccaugggcguguaccagauccuggccaucuacagcacggucgccagcucccucgugcugcuggugagccucggggccaucuccuucuggaugugcagcaacggcucccugcagugccgcaucugcaucuga

SEQ ID NO: 1110 - RNA, 1698 nt, Artificial Sequence; identical to SEQ ID NO: 1086
  derived and/or modified CDS sequence (AUadapt) from InfluenzaA__ABD95328__HA

SEQ ID NO: 1111 - RNA, 1701 nt, Artificial Sequence
  derived and/or modified CDS sequence (AUadapt) from InfluenzaA__ABD95339__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggucguacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacucggucacccgcggggugacggccuccugcagccacaagggcaaguccagcuucuaccggaaccuccuguggcugaccgagaagaacgggagcuaccccaaccucuccaagucguacgugaacgacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgugucgauggacgagugcgacgcgaagugccagacgccccagggcgccaucaacuccagccugccguuccagaacgugcaccccgucaccaucggcgagugccccaaguacgugcgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgccgcggaccagaaguccacgcagaacgccaucaacgggaucaccaacaaggucaacucggugaucgagaagaugaacacccaguucaccgccgugggcaaggaguucaacaagcuggagaagcgcauggagaaccucaacaagaaggucgacgacggcuuccuggacaucuggacguacaacgccgagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacaacgagugcauggagagcgugaagaacgggaccuacgacuacccgaaguacuccgaggagagcaagcucaaccgcgagaagaucgacggcgugaagcuggaguccauggggguguaccagauccuggcgaucuacucgaccguggccuccagccucguccugcuggugucccucggcgccaucagcuucuggaugugcuccaacggcagccugcagugccggaucugcaucuga

SEQ ID NO: 1112 - RNA, 1698 nt, Artificial Sequence; identical to SEQ ID NO: 987
  derived and/or modified CDS sequence (AUadapt) from InfluenzaA__ABE11657__HA

SEQ ID NO: 1113 - RNA, 1698 nt, Artificial Sequence
  derived and/or modified CDS sequence (AUadapt) from InfluenzaA__ABE11668__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccucguggcccaaccacaccgugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1114 - RNA, 1698 nt, Artificial Sequence
  derived and/or modified CDS sequence (AUadapt) from InfluenzaA__ABE11679__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggcggaacggccuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacucgcggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1115 - RNA, 1698 nt, Artificial Sequence
  derived and/or modified CDS sequence (AUadapt) from InfluenzaA__ABE11690__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1116 - RNA, 1698 nt, Artificial Sequence
  derived and/or modified CDS sequence (AUadapt) from InfluenzaA__ABE11701__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagaaggcccuguaccacacggagaacgccuacgugagcgucgugagcucccacuacucgcggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcaucaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacucgaacgugaagaaccuguacgagaaggugaagucccagcugaagaacaacgcgaaggagaucgggaacggcugcuucgaguucuaccacaagugcaacaacgagugcauggagagcgucaagaacggcaccuacgacuaccccaaguacuccgaggagagcaagcucaaccgcgagaagaucgacggggugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 1117 - RNA, 1698 nt, Artificial Sequence; identical to SEQ ID NO: 1045
  derived and/or modified CDS sequence (AUadapt) from InfluenzaA__ABE11712__HA

SEQ ID NO: 1118 - RNA, 1698 nt, Artificial Sequence; identical to SEQ ID NO: 1086
  derived and/or modified CDS sequence (AUadapt) from InfluenzaA__ABE11723__HA

SEQ ID NO: 1119 - RNA, 1698 nt, Artificial Sequence; identical to SEQ ID NO: 1092
  derived and/or modified CDS sequence (AUadapt) from InfluenzaA__ABE11734__HA

SEQ ID NO: 1120 - RNA, 1698 nt, Artificial Sequence; identical to SEQ ID NO: 1045
  derived and/or modified CDS sequence (AUadapt) from InfluenzaA__ABE11812__HA

SEQ ID NO: 1121 - RNA, 1698 nt, Artificial Sequence; identical to SEQ ID NO: 1086
  derived and/or modified CDS sequence (AUadapt) from InfluenzaA__ABE11823__HA

SEQ ID NO: 1122 - RNA, 1698 nt, Artificial Sequence; identical to SEQ ID NO: 1086
  derived and/or modified CDS sequence (AUadapt) from InfluenzaA__ABE11834__HA

SEQ ID NO: 1123 - RNA, 1698 nt, Artificial Sequence; identical to SEQ ID NO: 1086
  derived and/or modified CDS sequence (AUadapt) from InfluenzaA__ABE11845__HA

SEQ ID NO: 1124 - RNA, 1698 nt, Artificial Sequence; identical to SEQ ID NO: 1092
  derived and/or modified CDS sequence (AUadapt) from InfluenzaA__ABE11856__HA

SEQ ID NO: 1125 - RNA, 1701 nt, Artificial Sequence
  derived and/or modified CDS sequence (AUadapt) from InfluenzaA__ABE11900__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacucgaacgucaagaaccuguacgagaaggugaagacccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacucgaccguggccuccagccucguccugcugaucucccucggggccaucagcuucuggaugugcuccaacggcagccugcagugccgcaucugcaucuga

SEQ ID NO: 1126 - RNA, 1701 nt, Artificial Sequence
  derived and/or modified CDS sequence (AUadapt) from InfluenzaA__ABE11942__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccucgugcucccacaacggcaagagcuccuucuacaagaaccugcucuggcugacggagaagaacgggcuguaccccagccucuccaagagcuacgucaacaacaaggagaaggaggugcuggugcuguggggcguccaccaccccucgaacaucggggaccagcgggccaucuaccacaccgagaacgcguacguguccguggucagcucccacuacagccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucucccggggcuucgggucgggcaucaucaccuccaacgccagcaugggcgagugcgacgccaagugccagaccccgcagggggccaucaacuccagccugcccuuccagaacgugcaccccgucaccaucggcgagugccccaaguacgugcgcuccacgaagcugcggauggugaccgggcuccgcaacaucccgagcauccagucccggggccuguucggggccaucgcgggcuucaucgagggcggguggaccggcaugaucgacgggugguacggcuaccaccaccagaacgagcaggggucgggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacuccaacgucaagaaccuguacgagaaggugaagacccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgucaagcuggagucgaugggcguguaccagauccuggccaucuacuccaccguggccagcucccucguccugcuggugagccucggggccaucuccuucuggaugugcagcaacggcucccugcagugccgcaucugcaucuga

SEQ ID NO: 1127 - RNA, 1701 nt, Artificial Sequence
  derived and/or modified CDS sequence (AUadapt) from InfluenzaA__ABE12078__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccccggggcgggugaccgugucgaccaagcgcucccagcagaccgucauccccaacaucggcagccggcccugggugcgcggcguguccucgcggaucuccaucuacuggacgaucgucaagcccggggacauccuccugaucaacugcaccggcaaccugaucgccccgcgcggguacuucaagauccggagcggcaaguccucgaucaugcgcuccgacgccagcaucggcaagugcaacuccgagugcaucacccccaacgggucgauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccggaacggcaccuacgaccacgacguguaccgcgacgaggcccugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcuccaucugcaucuga

SEQ ID NO: 1128 - RNA, 1701 nt, Artificial Sequence; identical to SEQ ID NO: 1022
  derived and/or modified CDS sequence (AUadapt) from InfluenzaA__ABE12123__HA

SEQ ID NO: 1129 - RNA, 1698 nt, Artificial Sequence; identical to SEQ ID NO: 1045
  derived and/or modified CDS sequence (AUadapt) from InfluenzaA__ABE12248__HA

SEQ ID NO: 1130 - RNA, 1701 nt, Artificial Sequence
  derived and/or modified CDS sequence (AUadapt) from InfluenzaA__ABE12623__HA
augaagaccaucaucgcccugucguacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccucgaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcucgcuggucgcguccagcgggacccuggaguucaucaacgagggcuucaccuggaccggggugacgcagaacggcggguccaacgccugcaagcggggccccgacucgggcuucuucucccgccucaacuggcuguacaagagcggguccaccuaccccgugcugaacgucaccaugcccaacaacgacaacuucgacaagcucuacaucuggggcgugcaccacccgucgaccaaccaggagcagacgucccuguacgugcaggccagcgggcgggucaccguguccaccaagcgcucgcagcagaccaucauccccaacaucggcagccggcccugggugcgcggccuguccucgcggaucuccaucuacuggacgaucgucaagcccggggacauccucgugaucaacagcaacggcaaccugaucgccccgcgcggguacuucaagaugcggaccggcaaguccucgaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcucgccaccgggaugcggaacgugcccgagaagcagacccgcggccuguucggggccaucgccggcuucaucgagaacgggugggagggcaugaucgacggcugguacggguuccggcaccagaacucggagggcacggggcaggcggccgaccugaaguccacccaggccgccaucgaccagaucaacggcaagcucaaccgcgugaucgagaagaccaacgagaaguuccaccagaucgagaaggaguucagcgaggucgaggggcggauccaggaccuggagaaguacguggaggacaccaagaucgaccugugguccuacaacgccgagcuccugguggcgcuggagaaccagcacacgaucgaccucaccgacucggagaugaacaagcuguucgagaagacccgccggcagcugcgcgagaacgccgaggacaugggcaacggcugcuuccggaucuaccacaagugcgacaacgccugcaucggguccauccgcaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcgucgugcugcucggcuucaucaugugggcgugccagaaggggaacauccgcugcaacaucugcaucuga

SEQ ID NO: 1131 - RNA, 1701 nt, Artificial Sequence; identical to SEQ ID NO: 1075
  derived and/or modified CDS sequence (AUadapt) from InfluenzaA__ABE12645__HA

SEQ ID NO: 1132 - RNA, 1701 nt, Artificial Sequence; identical to SEQ ID NO: 1052
  derived and/or modified CDS sequence (AUadapt) from InfluenzaA__ABE13076__HA

SEQ ID NO: 1133 - RNA, 1701 nt, Artificial Sequence; identical to SEQ ID NO: 1028
  derived and/or modified CDS sequence (AUadapt) from InfluenzaA__ABE13323__HA

SEQ ID NO: 1134 - RNA, 1701 nt, Artificial Sequence
  derived and/or modified CDS sequence (AUadapt) from InfluenzaA__ABE13471__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggucgcuggucgccuccagcggcacgcuggaguucuacaacgaguccuucaacuggaccgggguggcccagaacggcaccucguacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccucgacggacuccgaccagaccagccuguacgugcaggccuccgggcgggucaccgugagcaccaagcgcucgcagcagacggugaucccgaacaucgggucccggcccuggguccgcggcgugagcucccggaucucgaucuacuggaccaucgugaagcccggcgacauccuccugaucaacuccaccgggaaccugaucgcgccccgcggcuacuucaagauccggagcgggaaguccucgaucaugcgcuccgacgccccgaucggcaacugcaacagcgagugcaucacccccaacggcuccauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggguucaucgagaacggcugggagggcauggucgacgggugguacggcuuccggcaccagaacucggaggggacgggccaggccgccgaccugaaguccacccaggcggccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacucggagaugaacaagcuguucgagcgcacccgcaagcagcuccgggagaacgccgaggacaugggcaacgggugcuuccgcaucuaccacaagugcgacaacgcgugcaucggcuccauccggaacgggaccuacgaccacgacguguaccgcgacgaggcccugaacaaccgguuccagaucaagggcgucgagcucaagagcggguacaaggacuggauccuguggaucuccuucgccaucagcugcuuccugcugugcguggugcuccugggcuucaucaugugggccugccagaagggcaacauccgcugcaacaucugcaucuga

SEQ ID NO: 1135 - RNA, 1701 nt, Artificial Sequence
  derived and/or modified CDS sequence (AUadapt) from InfluenzaA__ABE13555__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggagcuccaccggccgcaucugcgacucgccccaccggauccuggacgggaagaacugcacccugaucgacgcccuccugggcgacccccacugcgacggcuuccagaacaaggagugggaccuguucguggagcgcuccaaggccuacagcaacugcuaccccuacgacgugccggacuacgcgucccuccggucgcuggucgccuccagcgggacgcuggaguucaacaacgaguccuucaacuggaccggcguggcccagaacgggaccucguacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccucgacggacuccgaccagaccagccuguacgugcaggccuccgggcgggucaccgugucgaccaagcgcagccagcagacggugaucccgaacaucggcucccggcccuggguccgcggcgugucgucccggaucagcaucuacuggaccaucgugaagcccggggacauccuccugaucuccucgaccggcaaccugaucgcgccccgcggguacuucaagauccgguccggcaagagcuccaucaugcgcucggacgccccgaucgacaacugcaacuccgagugcaucacccccaacggcagcauccccaacgacaagcccuuccagaacgucaaccggaucacguacggggccugcccgcgcuacgugaagcagaacacccucaagcuggccaccggcaugcggaacgugcccgagaagcagaccaaggggaucuucggcgccaucgccggguucaucgagaacggcugggagggcauggucgacgggugguacggcuuccgccaccagaacuccgaggggacgggccaggccgccgaccucaagucgacccaggcggccaucaaccagaucaacgggaagcugaaccggcugaucgagaagaccaacgagaaguuccaccagaucgagaaggaguucuccgagguggagggccgcauccaggaccuggagaaguacguggaggacaccaagaucgaccucuggagcuacaacgccgagcugcuggucgcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacguguaccgcgacgaggcccugaacaaccgguuccagaucaagggcgucgagcugaaguccggguacaaggacuggauccucuggaucagcuucgccaugagcugcuuccugcugugcguggugcuccugggcuucaucaugugggccugccagaagggcaacauccgcugcaacaucugcaucuga

SEQ ID NO: 1136 - RNA, 1701 nt, Artificial Sequence
  derived and/or modified CDS sequence (AUadapt) from InfluenzaA__ABE13606__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagaugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaccaacgagggguucaacuggaccggcguggcccaggacgggaccagcuacgccugcaagcgcggcuccgugaaguccuucuucucccggcugaacuggcuccacaagcuggaguacaaguaccccgcgcugaacgucacgaugcccaacaacgacaaguucgacaagcucuacaucuggggcgugcaccaccccucgaccgacuccgaccagaccagccuguacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccugcucaucaacuccaccgggaaccugaucgcgccccggggcuacuucaagauccgcucgggcaaguccagcaucaugcgguccgacgccccgaucgggaacugcaacucggagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcugaaccggcucaucgagaagaccaacgagaaguuccaccagaucgagaaggaguucucggagguggaggggcgcauccaggaccuggagaaguacguggaggacacgaagaucgaccugugguccuacaacgccgagcuccugaucgcccuggagaaccagcacaccaucgaccucaccgacagcgagaugaacaagcuguucgagcggacccgcaagcagcugcgcgagaacgccgaggacaugggcaacgggugcuucaagaucuaccacaagugcgacaacgcgugcaucggcuccauccggaacgggacguacgaccacgacgucuaccgcgacgaggcccucaacaaccgguuccagaucaagggcguggagcucaagucgggcuacaaggacuggauccuguggaucuccuucgccaucagcugcuuccugcugugcgucgugcugcucggguucaucaugugggccugccagaagggcaacauccgcugcaacaucugcaucuga

SEQ ID NO: 1137 - RNA, 1701 nt, Artificial Sequence
  derived and/or modified CDS sequence (AUadapt) from InfluenzaA__ABE13628__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgagggguucaacuggaccggcguggcccaggacgggaaguccuacgccugcaagcgcggcuccgugaacucguucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccucgcuguacgugcaggccuccgggcgcgucaccgugagcaccaagcggucgcagcagacggugaucccgaacaucggcucccgccccuggguccgggggaucagcucccgcaucucgaucuacuggaccaucgugaagcccggcgacauccuccugaucaacuccaccgggaaccugaucgcgccccggggcuacuucaagauccgcaacggcaagagcuccaucaugcggucggacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagucgacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 1138 - RNA, 1701 nt, Artificial Sequence
  derived and/or modified CDS sequence (AUadapt) from InfluenzaA__ABE13824__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaccaacgagggguucaacuggaccggcguggcccaggacgggaaguccuacgccugcaagcgcggcuccgugaacucguucuucucccggcugaacuggcuccacaagcuggaguacaaguaccccgcgcugaacgucaccaugcccaacaacgacaaguucgacaagcucuacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccugcucaucaacuccaccgggaaccugaucgcgccccggggcuacuucaagauccgcaacggcaagucguccaucaugcggucggacgccccgaucgacaacugcaacuccgagugcaucacccccaacgggagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagucgacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggacccgcaagcagcugcgcgagaacgccgaggacauggggaacggcugcuucaagaucuaccacaagugcgacaacgcgugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 1139 - RNA, 1701 nt, Artificial Sequence; identical to SEQ ID NO: 1138
  derived and/or modified CDS sequence (AUadapt) from InfluenzaA__ABE14019__HA

SEQ ID NO: 1140 - RNA, 1701 nt, Artificial Sequence
  derived and/or modified CDS sequence (AUadapt) from InfluenzaA__ABE14030__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaucgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacccuggaguucacgaacgagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccucgaccgacuccgaccagacgagccuguacgugcaggccuccgggcgcgucaccgugucgaccaagcggagccagcagaccgugaucccgaacaucggcucccgccccuggguccgggggaucucgucccgcaucagcaucuacuggacgaucgugaagcccggcgacauccuccugaucaacuccaccgggaaccugaucgcgccccggggcuacuucaagauccgcaacggcaagucguccaucaugcggagcgacgccccgaucgacaacugcaacuccgagugcaucacccccaacgggucgauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacgcaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugacggacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 1141 - RNA, 1701 nt, Artificial Sequence; identical to SEQ ID NO: 1137
  derived and/or modified CDS sequence (AUadapt) from InfluenzaA__ABE14041__HA

SEQ ID NO: 1142 - RNA, 1701 nt, Artificial Sequence; identical to SEQ ID NO: 1138
  derived and/or modified CDS sequence (AUadapt) from InfluenzaA__ABE14063__HA

SEQ ID NO: 1143 - RNA, 1701 nt, Artificial Sequence
  derived and/or modified CDS sequence (AUadapt) from InfluenzaA__ABE14124__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccucgaccgacuccgaccagaccagccuguacgugcaggccuccgggcgcgucaccgugucgacgaagcggagccagcagaccgugaucccgaacaucggcucccgccccuggguccgcggggugucgucccggaucagcaucuacuggaccaucgugaagcccggcgacauccuccugaucaacuccaccgggaaccugaucgcgccccggggcuacuucaagauccgcucgggcaaguccagcaucaugcgguccgacgccccgaucgggaacugcaacucggagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucucggagguggaggggcgcauccaggaccuggagaaguacguggaggacacgaagaucgaccucugguccuacaacgccgagcugcugaucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacgucuaccgcgacgaggcccugaacaaccgguuccagaucaagggcguggagcucaagucgggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 1144 - RNA, 1701 nt, Artificial Sequence
  derived and/or modified CDS sequence (AUadapt) from InfluenzaA__ABE14464__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaccaacgagggguucaacuggaccggcguggcccaggacgggaaguccuacgccugcaagcgcggcuccgugaacucguucuucucccggcugaacuggcuccacaagcuggaguacaaguaccccgcgcugaacgucaccaugcccaacaacgacaaguucgacaagcucuacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccugcucaucaacuccaccgggaaccugaucgcgccccggggcuacuucaagauccgcaacggcaagucguccaucaugcggucggacgccccgaucgacaacugcaacuccgagugcaucacccccaacgggagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacggcugggaggggaugaucgacggcugguacggguuccgccaccagaacuccgagggcacggggcaggccgccgaccucaagucgacccaggcggccaucgaccagaucaacggcaagcugaaccggcugaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggacccgcaagcagcugcgcgagaacgccgaggacauggggaacggcugcuucaagaucuaccacaagugcgacaacgcgugcaucgggucgauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcgugguccugcucggcuucaucaugugggccugccagaaggggaacauccgcugcaacaucugcaucuga

SEQ ID NO: 1145 - RNA, 1701 nt, Artificial Sequence
  derived and/or modified CDS sequence (AUadapt) from InfluenzaA__ABE14840__HA
augaagaccaucaucgcccugucguacauccucugccugguguucgcccagaagcugccccgcaacgacaacuccaccgcgacgcucugccugggccaccacgccgucccgaacgggacccuggugaagaccaucaccaacgaccagaucgaggugacgaacgccaccgagcucguccagagcuccucgaccggccggaucugcgacagcccccaccgcauccuggacgggaagaacugcacccugaucgacgcccuccugggcgacccccacugcgacggguuccagaacaaggagugggaccuguucguggagcggucgaaggccuacuccaacugcuaccccuacgacgugccggacuacgcgagccuccgcucccuggucgccucguccggcacgcuggaguucaccaacgagggcuucaacuggaccgggguggcccaggacggcaagagcuacgccugcaagcggggguccgugaacucguucuucucccgccucaacuggcugcacaagcuggaguacaaguaccccgcgcucaacgucaccaugcccaacaacgacaaguucgacaagcuguacaucuggggcgugcaccaccccagcacggacuccgaccagaccucgcuguacgugcaggccuccgggcgggucaccgugagcaccaagcgcucgcagcagacggugaucccgaacaucggcucccggcccuggguccgcggcaucagcucccggaucucgaucuacuggaccaucgugaagcccggggacauccuccugaucuccagcaccggcaaccugaucgcgccccgcggguacuucaagauccggaacggcaaguccucgaucaugcgcuccgacgccccgaucgacaacugcaacagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggguucaucgagaacggcugggagggcaugguggacgggugguacggcuuccggcaccagaacucggaggggacgggccaggccgccgaccugaaguccacccaggcggccaucgaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcugaaguccggguacaaggacuggauccucuggaucuccuucgccaucagcugcuuccugcugugcgucgugcuccugggcuucaucaugugggccugccagaagggcaacauccggugcagcaucugcaucuga

SEQ ID NO: 1146 - RNA, 1701 nt, Artificial Sequence
  derived and/or modified CDS sequence (AUadapt) from InfluenzaA__ABE15578__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagauccgcaacggcaagucguccaucaugcggagcgacgccccgaucgacaacugcaacuccgagugcaucacccccaacgggucgauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucucguucgccaucuccugcuuccugcugugcgucgugcuccugggcuucaucaugugggccugccagaaggggaacauccgcugcagcaucugcaucuga

SEQ ID NO: 1147 - RNA, 1701 nt, Artificial Sequence
  derived and/or modified CDS sequence (AUadapt) from InfluenzaA__ABE26991__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgacugcgacgccaagugccagaccccgcagggggccaucaacagcucccugcccuuccagaacgugcaccccgucaccaucggcgagugccccaaguacgugcgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacucgaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccacccucaagcgggagaagaucgacggcgucaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 1148 - RNA, 1701 nt, Artificial Sequence
  derived and/or modified CDS sequence (AUadapt) from InfluenzaA__ABF47550__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccucguccggcacgcuggaguucaucaacgaggacuucaacuggaccggggugacccagagcggcggguccuacgccugcaagcgcggcucggugaacuccuucuucagccggcugaacuggcuccacgaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugucgaccaagcggagccagcagacggugaucccgaacaucgggucccgccccuggguccggggccugucgucccgcaucagcaucuacuggaccaucgugaagcccggggacauccugcucaucaacuccaccggcaaccugaucgcgccccggggcuacuucaagauccgcaccgggaaguccuccaucaugcggucggacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacucggagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacucggagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 1149 - RNA, 1698 nt, Artificial Sequence
  derived and/or modified CDS sequence (AUadapt) from InfluenzaA__ABF47561__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaagcugagcauguccuacgugaacaacaaggagaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1150 - RNA, 1698 nt, Artificial Sequence
  derived and/or modified CDS sequence (AUadapt) from InfluenzaA__ABF47572__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggacaaggaggugcucguccuguggggcgugcaccacccgcccaacaucggcgaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1151 - RNA, 1698 nt, Artificial Sequence; identical to SEQ ID NO: 1045
  derived and/or modified CDS sequence (AUadapt) from InfluenzaA__ABF47583__HA

SEQ ID NO: 1152 - RNA, 1701 nt, Artificial Sequence
  derived and/or modified CDS sequence (AUadapt) from InfluenzaA__ABF47594__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccgggguggcccagaacggcaccuccuacgccugcaagcgccggagcgugaaguccuucuucucgcgccucaacuggcugcacaagcuggaguacaaguaccccgcgcagaacgucaccaugcccaacaacgacaaguucgacaagcucuacaucuggggcgugcaccaccccuccacggacagcgaccagaccucccuguacgugcaggccucggggcgggucaccgugagcaccaagcgcucccagcagacggugaucccgaacaucgggucgcggcccuggguccgcggcguguccagccggaucuccaucuacuggaccaucgugaagcccggcgacauccugcucaucaacucgaccgggaaccugaucgcgccccgcggcuacuucaagauccgguccgggaaguccuccaucaugcgcagcgacgccccgaucggcaacugcaacuccgagugcaucacccccaacggcucgauccccaacgacaagcccuuccagaacgucaaccggaucacguacggggccugcccgcgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacuccgaggggacgggccaggccgccgaccucaagagcacccaggcggccaucaaccagaucaacgggaagcugaaccgccugaucgagaagaccaacgagaaguuccaccagaucgagaaggaguucuccgagguggagggccggauccaggaccuggagaaguacguggaggacaccaagaucgaccuguggucguacaacgccgagcuccuggucgcccuggagaaccagcacacgaucgaccucaccgacuccgagaugaacaagcuguucgagcgcacccgcaagcagcugcgggagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggguacaaggacuggauccuguggaucucguucgccaucagcugcuuccuccugugcguggugcugcucggcuucaucaugugggccugccagaagggcaacauccggugcaacaucugcaucuga

SEQ ID NO: 1153 - RNA, 1701 nt, Artificial Sequence
  derived and/or modified CDS sequence (AUadapt) from InfluenzaA__ABF47605__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccucgugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugucgguggucuccagccacuacucccgccgguucaccccggagaucgccaagcgccccaaggugcgggaccaggagggccgcaucaacuacuacuggacccuccuggagcccggcgacacgaucaucuucgaggccagcgggaaccugaucgcccccugguacgccuucgcgcucucccggggcuucgggucgggcaucaucaccuccaacgccagcaugggcgagugcgacgccaagugccagaccccgcagggggccaucaacuccagccugcccuuccagaacgugcaccccgucaccaucggcgagugccccaaguacgugcgcuccacgaagcugcggauggugaccgggcuccgcaacaucccgagcauccagucccggggccuguucggggccaucgcgggcuucaucgagggcggguggaccggcaugaucgacgggugguacggcuaccaccaccagaacgagcaggggucgggcuacgccgccgacaagaaguccacccagaacgccaucgacggcaucacgaacaaggucaacagcgugaucgagaagaugaacacccaguucaccgccguggggaaggaguucaacaagcuggagcgccggaucgagaaccucaacaagaaggucgacgacggcuuccuggacaucuggaccuacaacgcggagcugcucgugcugcuggagaacgagcgcacgcucgacuuccacgacuccaacgucaagaaccuguacgagaaggugaagaaccagcugaagaacaacgccaaggagaucgggaacggcugcuucgaguucuaccacaagugcaacaacgagugcauggagagcgugaagaacgggaccuacgacuaccccaaguacuccgaggagagcaagcucaagcgggagaagaucgacggcgucaagcuggagucgaugggcguguaccagauccuggccaucuacuccaccguggccagcucccucguccugcuggugagccucggggccaucuccuucuggaugugcagcaacggcucccugcagugccgcaucugcaucuga

SEQ ID NO: 1154 - RNA, 1701 nt, Artificial Sequence; identical to SEQ ID NO: 1138
  derived and/or modified CDS sequence (AUadapt) from InfluenzaA__ABF47616__HA

SEQ ID NO: 1155 - RNA, 1701 nt, Artificial Sequence
  derived and/or modified CDS sequence (AUadapt) from InfluenzaA__ABF47627__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgacugcgacgccaagugccagaccccgcagggggccaucaacagcucccugcccuuccagaacgugcaccccgucaccaucggcgagugccccaaguacgugcgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacucgaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgggagaagaucgacggcgucaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 1156 - RNA, 1701 nt, Artificial Sequence
  derived and/or modified CDS sequence (AUadapt) from InfluenzaA__ABF47638__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucaccaagcgccccaaggugcgggaccaggagggccgcaucaacuacuacuggacgcuccuggagcccggcgacaccaucaucuucgaggccaacgggaaccugaucgcccccugguacgccuucgcccucucgcggggcuucggguccggcaucaucaccagcaacgcguccaugggcgagugcgacgccaagugccagaccccgcagggggccaucaacagcucccugcccuuccagaacgugcaccccgucacgaucggcgagugccccaaguacgugcgcucgaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacgcagaacgccaucgacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacucgaacgucaagaaccuguacgagaaggugaagacccagcugaagaacaacgcgaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacucgacgguggccuccagccucguccugcuggugucccucggggccaucagcuucuggaugugcuccaacggcagccugcagugccgcaucugcaucuga

SEQ ID NO: 1157 - RNA, 1701 nt, Artificial Sequence; identical to SEQ ID NO: 1156
  derived and/or modified CDS sequence (AUadapt) from InfluenzaA__ABF47649__HA

SEQ ID NO: 1158 - RNA, 1701 nt, Artificial Sequence
  derived and/or modified CDS sequence (AUadapt) from InfluenzaA__ABF47660__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcauccaccaccccagcaacaucggggaccagcgggccaucuaccacaccgagaacgcguacgucagcgugguguccagccacuacucccgccgguucaccccggagaucgccaagcgccccaagguccgggaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgacugcgacgccaagugccagaccccgcagggggccaucaacagcucccugcccuuccagaacgugcaccccgugaccaucggcgagugccccaaguacguccgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggugaacagcgucaucgagaagaugaacacccaguucaccgccguggggaaggaguucaacaagcuggagcgccggauggagaaccucaacaagaagguggacgacggcuuccuggacaucuggaccuacaacgcggagcugcucguccugcuggagaacgagcgcacgcucgacuuccacgacucgaacgugaagaaccuguacgagaaggucaagacccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgggagaagaucgacggcgugaagcuggagagcaugggcgucuaccagauccuggccaucuacucgaccguggccuccagccucgugcugcuggucucccucggggccaucagcuucuggaugugcuccaacggcagccugcagugccgcaucugcaucuga

SEQ ID NO: 1159 - RNA, 1698 nt, Artificial Sequence
  derived and/or modified CDS sequence (AUadapt) from InfluenzaA__ABF47671__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagucguccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuucgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagucgcgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 1160 - RNA, 1701 nt, Artificial Sequence
  derived and/or modified CDS sequence (AUadapt) from InfluenzaA__ABF47693__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagucgcucuucuccaagaaguccuggagcuacaucgccgagacccccaacucggagaacgggaccugcuaccccggcuacuucgccgacuacgaggagcugcgggagcagcuguccagcguguccagcuucgagcgcuucgagaucuuccccaaggagcgguccuggccgaagcacaacgucacccgcggcgugacggccucgugcucccacaagggcaagagcuccuucuaccggaaccuccuguggcugaccgagaagaacgggucguaccccaaccucuccaagagcuacgugaacaacaaggagaaggagguccuggugcuguggggcgugcaccaccccucgaacaucgaggaccagaagaccaucuaccgcaaggagaacgccuacgucuccguggugagcuccaacuacaaccggcgcuucacccccgagaucgcggagcggccgaagguccgcgggcaggccggccggaucaacuacuacuggacgcuccuggagcccggcgacaccaucaucuucgaggccaacgggaaccugaucgcccccuggcacgccuucgcgcucaaccgcggcuucgggagcggcaucaucaccuccaacgccucgauggacgagugcgacaccaagugccagacgccccagggcgccaucaacuccagccugccguuccagaacauccaccccgugaccaucggggagugccccaaguacgugcgguccaccaagcugcgcauggucaccggccuccggaacauccccucgauccagucccgcgggcuguucggcgccaucgccggguucaucgagggcggcuggacggggaugaucgacggcugguacggguaccaccaccagaacgagcagggcagcggguacgcggccgaccagaaguccacccagaacgccaucaacggcaucaccaacaaggugaacucggugaucgagaagaugaacacccaguucacggccgucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacuccaacgucaagaaccuguacgagaaggucaagagccagcugaagaacaacgcgaaggagaucggcaacgggugcuucgaguucuaccacaagugcaacaacgagugcauggaguccgugaagaacggcaccuacgacuacccgaaguacagcgaggaguccaagcucaaccgggagaagaucgacggggugaagcuggagucgaugggcguguaccagauccuggccaucuacagcacggucgccuccucgcucgugcugcuggugucccucggcgccaucagcuucuggaugugcuccaacgggagccugcagugccgcaucugcaucuga

SEQ ID NO: 1161 - RNA, 1701 nt, Artificial Sequence; identical to SEQ ID NO: 1160
  derived and/or modified CDS sequence (AUadapt) from InfluenzaA__ABF47704__HA

SEQ ID NO: 1162 - RNA, 1701 nt, Artificial Sequence
  derived and/or modified CDS sequence (AUadapt) from InfluenzaA__ABF47715__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcucgaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugucguccgugagcuccuucgagcgcuucgagaucuuccccaaggagcggucguggccgaagcacaacgucacccgcggcgugacggccuccugcagccacaagggcaaguccagcuucuaccggaaccuccuguggcugaccgagaagaacggguccuaccccaaccucucgaagagcuacgugaacaacaaggagaaggagguccuggugcuguggggcgugcaccaccccuccaacaucgaggaccagaagaccaucuaccgcaaggagaacgccuacgucagcgugguguccucgaacuacaaccggcgcuucacccccgagaucgcggagcggccgaagguccgcgggcaggccggccggaucaacuacuacuggacgcuccuggagcccggcgacaccaucaucuucgaggccaacgggaaccugaucgcccccuggcacgccuucgcgcucaaccgcggcuucggguccggcaucaucaccagcaacgccuccauggacgagugcgacaccaagugccagacgccccagggcgccaucaacucgucccugccguuccagaacauccaccccgugaccaucggggagugccccaaguacgugcggagcaccaagcugcgcauggucaccggccuccggaacauccccuccauccagagccgcgggcuguucggcgccaucgccggguucaucgagggcggcuggacggggaugaucgacggcugguacggguaccaccaccagaacgagcagggcuccggguacgcggccgaccagaaguccacccagaacgccaucaacggcaucaccaacaaggugaacucggugaucgagaagaugaacacccaguucacggccgucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacagcaacgucaagaaccuguacgagaaggugaagucccagcugaagaacaacgcgaaggagaucggcaacgggugcuucgaguucuaccacaagugcaacaacgagugcauggagucggucaagaacggcaccuacgacuacccgaaguacuccgaggagagcaagcucaaccgggagaagaucgacggggugaagcuggagagcaugggcguguaccagauccuggccaucuacuccacggucgccucgucccucgugcugcuggugagccucggcgccaucuccuucuggaugugcagcaacgggucccugcagugccgcaucugcaucuga

SEQ ID NO: 1163 - RNA, 1701 nt, Artificial Sequence; identical to SEQ ID NO: 1160
  derived and/or modified CDS sequence (AUadapt) from InfluenzaA__ABF47726__HA

SEQ ID NO: 1164 - RNA, 1701 nt, Artificial Sequence; identical to SEQ ID NO: 1160
  derived and/or modified CDS sequence (AUadapt) from InfluenzaA__ABF47737__HA

SEQ ID NO: 1165 - RNA, 1701 nt, Artificial Sequence
  derived and/or modified CDS sequence (AUadapt) from InfluenzaA__ABF47748__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagagcuccuggccgaagcacaacgucacccgcggggugacggccagcugcucccacaagggcaagagcuccuucuaccggaaccuccuguggcugaccgagaagaacgggucguaccccaaccucagcaaguccuacgugaacaacaaggagaaggagguccuggugcuguggggcgugcaccaccccagcaacaucgaggaccagaagaccaucuaccggaaggagaacgccuacgucuccguggugucgucccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucagccggggguucggcuccgggaucaucaccagcaacgcguccauggacgagugcgacgccaagugccagacgccccagggcgccaucaacucgucccugccguuccagaacgugcaccccgugaccaucggcgagugccccaaguacguccgcagcaccaagcugcggauggugaccgggcuccgcaacauccccuccauccagagccggggccuguucggggccaucgccggcuucaucgagggcggcuggaccggcaugaucgacgggugguacggcuaccaccaccagaacgagcagggguccggcuacgcggccgaccagaaguccacgcagaacgccaucaacgggaucaccaacaaggugaacagcgucaucgagaagaugaacacccaguucaccgccgugggcaaggaguucaacaagcuggagaagcgcauggagaaccucaacaagaagguggacgacggcuuccuggacaucuggacguacaacgccgagcugcucguccugcuggagaacgagcggacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuacccgaaguacagcgaggaguccaagcucaaccgcgagaagaucgacggcgugaagcuggagucgaugggggucuaccagauccuggccaucuacuccaccguggccagcucccucgugcugcuggucagccucggcgccaucuccuucuggaugugcagcaacggcucccugcagugccggaucugcaucuga

SEQ ID NO: 1166 - RNA, 1701 nt, Artificial Sequence
  derived and/or modified CDS sequence (AUadapt) from InfluenzaA__ABF47770__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggucguacaucgccgagacccccaacagcgagaacgggaccugcuaccccggcuacuucgccgacuacgaggagcugcgcgagcagcuguccagcguguccucguucgagcgguucgagaucuuccccaaggaguccagcuggccgaagcacaacgucaccaagggggugacggccuccugcagccacaagggcaaguccucguucuaccgcaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucucggugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgucgauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggucgggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacucggaggagagcaagcucaaccgcgagaagaucgacggcgugaagcuggaguccauggggguguaccagauccuggccaucuacagcaccgucgccuccucgcucgugcugcuggugucccucggcgccaucagcuucuggaugugcuccaacggcagccugcagugccggaucugcaucuga

SEQ ID NO: 1167 - RNA, 1701 nt, Artificial Sequence; identical to SEQ ID NO: 1166
  derived and/or modified CDS sequence (AUadapt) from InfluenzaA__ABF47781__HA

SEQ ID NO: 1168 - RNA, 1701 nt, Artificial Sequence; identical to SEQ ID NO: 1166
  derived and/or modified CDS sequence (AUadapt) from InfluenzaA__ABF47792__HA

SEQ ID NO: 1169 - RNA, 1701 nt, Artificial Sequence; identical to SEQ ID NO: 1166
  derived and/or modified CDS sequence (AUadapt) from InfluenzaA__ABF47803__HA

SEQ ID NO: 1170 - RNA, 1701 nt, Artificial Sequence; identical to SEQ ID NO: 1166
  derived and/or modified CDS sequence (AUadapt) from InfluenzaA__ABF47814__HA

SEQ ID NO: 1171 - RNA, 1701 nt, Artificial Sequence; identical to SEQ ID NO: 1166
  derived and/or modified CDS sequence (AUadapt) from InfluenzaA__ABF47825__HA

SEQ ID NO: 1172 - RNA, 1701 nt, Artificial Sequence; identical to SEQ ID NO: 1166
  derived and/or modified CDS sequence (AUadapt) from InfluenzaA__ABF47836__HA

SEQ ID NO: 1173 - RNA, 1701 nt, Artificial Sequence; identical to SEQ ID NO: 1166
  derived and/or modified CDS sequence (AUadapt) from InfluenzaA__ABF47847__HA

SEQ ID NO: 1174 - RNA, 1701 nt, Artificial Sequence
  derived and/or modified CDS sequence (AUadapt) from InfluenzaA__ABF47858__HA
augaagaccaucaucgcccugucguacauccucugccugguguucgcccagaagcugcccggcaacgacaacgggaccgcgacgcucugccugggccaccacgccgucccgaacgggacccuggugaagaccaucaccaacgaccagaucgaggugacgaacgccaccgagcucguccaguccagcuccaccggccgcaucugcgacucgccccaccggauccuggacgggaagaacugcacccugaucgacgcccuccugggcgacccccacugcgacggcuuccagaacaaggagugggaccuguucguggagcgcuccaaggccuacagcaacugcuaccccuacgacgugccggacuacgcgucccuccggucgcuggucgccuccagcgggacgcuggaguucaucaacgaggacuucaacuggaccggcguggcccaggacgggaaguccuacgccugcaagcgcggcagcgugaacuccuucuucucgcggcucaacuggcugcacaagcuggaguacaaguaccccgcgcucaacgucaccaugcccaacaacgggaaguucgacaagcuguacaucuggggcgugcaccaccccuccaccgacagcgaccagacgucccuguacgugcgcgccucgggccgggucaccguguccaccaagcgcagccagcagaccgugaucccgaacaucggguuccggcccuggguccgcggccucucgucccggaucagcaucuacuggacgaucgugaagcccggggacauccugcugaucaacuccaccggcaaccucaucgcgccccgcggcuacuucaagauccggaacggcaagagcuccaucaugcgcucggacgccccgaucgggaacugcuccagcgagugcaucacccccaacggguccauccccaacgacaagcccuuccagaacgugaaccggaucaccuacggcgccugcccgcgcuacgucaagcagaacacgcugaagcuggccaccgggaugcggaacgugcccgagaagcagacccgcggcaucuucggcgccaucgccggguucaucgagaacggcugggaggggaugguggacggcugguacggguuccggcaccagaacucggagggcaccggccaggccgccgaccucaaguccacgcaggcggccaucgaccagaucaacgggaagcugaaccgccugaucgagaagaccaacgagaaguuccaccagaucgagaaggaguucagcgaggucgagggccggauccaggaccucgagaaguacguggaggacaccaagaucgaccugugguccuacaacgccgggcugcucguggcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgcgugcaucggcuccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 1175 - RNA, 1698 nt, Artificial Sequence; identical to SEQ ID NO: 987
  derived and/or modified CDS sequence (AUadapt) from InfluenzaA__ABF47869__HA

SEQ ID NO: 1176 - RNA, 1698 nt, Artificial Sequence; identical to SEQ ID NO: 987
  derived and/or modified CDS sequence (AUadapt) from InfluenzaA__ABF47880__HA

SEQ ID NO: 1177 - RNA, 1698 nt, Artificial Sequence
  derived and/or modified CDS sequence (AUadapt) from InfluenzaA__ABF47891__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucacccggaagaacgggcuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacucgcggcgcuucacccccgagaucgccaagcggcccaaggugcgcgaccaggagggccggaucaacuacuacuggacccuccuggagcccggcgacaccaucaucuucgaggcgaacgggaaccugaucgccccgcgcuacgccuucgcccucucccggggcuucgggagcggcaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagucgcgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagucgaagcucaaccgggagaagaucgacggggugaagcuggaguccaugggcgucuaccagauccuggccaucuacagcacgguggccagcucccucgugcugcuggucagccucggcgccaucuccuucuggaugugcagcaacgggucccugcagugccgcaucugcaucuga

SEQ ID NO: 1178 - RNA, 1701 nt, Artificial Sequence
  derived and/or modified CDS sequence (AUadapt) from InfluenzaA__ABF47902__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccccggggcgggugaccgugucgaccaagcgcucccagcagaccgucauccccaacaucggcagccggcccugggugcgcggcguguccucgcggaucuccaucuacuggacgaucgucaagagcggggacauccuccugaucaacugcaccggcaaccugaucgcgccccgcggguacuucaagauccgguccggcaagucguccaucaugcgcagcgacgccuccaucggcaagugcaacucggagugcaucaccccgaacggguccauccccaacgacaagcccuuccagaacgugaaccggaucaccuacggcgccugcccccgcuacgugaagcagaacacgcucaagcuggccaccgggaugcggaacgucccggagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucucggagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 1179 - RNA, 1698 nt, Artificial Sequence
  derived and/or modified CDS sequence (AUadapt) from InfluenzaA__ABF47955__HA
augaaggccaagcugcucgugcugcuguacgccuucgucgcgaccgacgccgacaccaucugcaucggcuaccacgccaacaacucgacggacaccguggacaccaucuucgagaagaacguggccgucacccacuccgugaaccuccuggaggaccgccacaacgggaagcugugcaagcucaagggcaucgcgccccugcagcuggggaagugcaacaucacgggcuggcuccuggggaacccggagugcgacagccugcuccccgcccgguccuggagcuacaucguggagacccccaacuccgagaacggcgccugcuaccccggcgacuucaucgacuacgaggagcugcgcgagcagcugagcuccgucucgucccucgagcgguucgagaucuucccgaaggagagcuccuggcccaaccacaccuucaacggggugaccgugagcugcucccaccgcggcaagagcuccuucuaccggaaccugcuguggcucacgaagaagggggacucguaccccaagcugaccaacuccuacgucaacaacaagggcaaggaggugcuggugcucuggggcguccaccaccccagcuccagcgacgagcagcagagccuguacuccaacgggaacgccuacgugagcguggccuccucgaacuacaaccgccgguucaccccggagaucgcggcccgccccaaggucaaggaccagcacggccggaugaacuacuacuggacccugcucgagcccggggacacgaucaucuucgaggccaccggcaaccugaucgcccccugguacgccuucgcgcugucccgcggguucgagagcggcaucaucaccuccaacgccagcaugcacgagugcaacaccaagugccagacgccgcagggcuccaucaacagcaaccuccccuuccagaacauccaccccgugaccaucggggagugccccaaguacgugcgguccaccaagcugcgcauggucaccggccugcggaacaucccgucgauccaguaccgcggccucuucggggccaucgccggguucaucgagggcggcuggacggggaugaucgacggcugguacggguaccaccaccagaacgagcagggcuccggguacgccgcggaccagaaguccacccagaacgccaucaaccggaucaccaacaaggugaacagcgugaucgagaagaugaacacccaguucacggccgucggcaaggaguucaacaaccuggagaagcgcauggagaaccugaacaagaagguggacgacggcuuccucgacaucuggaccuacaacgccgagcugcuggugcuccuggagaacgagcggacccuggacuuccacgaccucaacgucaagaaccuguacgagaaggucaagagccagcugaagaacaacgccaaggagaucgggaacggcugcuucgaguucuaccacaagugcgacaacgagugcauggaguccgugcgcaacgggaccuacgacuaccccaaguacagcgaggaguccaagcucaaccgggagaagaucgacggcgugaagcuggagucgauggggguguaccagauccuggcgaucuacagcacggucgccuccagccucgugcugcuggugucccucggcgccaucagcuucuggaugugcuccaacggcagccugcagugccgcaucugcaucuga

SEQ ID NO: 1180 - RNA, 1698 nt, Artificial Sequence
  derived and/or modified CDS sequence (AUadapt) from InfluenzaA__ABF60576__HA
augaagaccaccaucauccugauccuccugacgcacgccguggacucgcagaaccccaucuccggcaacaacaccgccacccugugccucgggcaccacgcggucgccaacggcacccuggugaagacgaucaccgacgaccagaucgaggugaccaacgccaccgagcugguccagucgacguccaucgggaagaucugcaacaacccguaccgcgugcucgacggccggaacugcacccugaucgacgccaugcugggggacccccacugcgacguguuccaguacgagaacugggaccucuucaucgagcgcucguccgccuucagcaacugcuaccccuacgacauccccgacuacgcgucccugcggucgaucgucgccuccucgggcacccuggaguucaccgccgagggcuucacguggaccggggugacccagaacggcggguccggcgccugccgccgggggucggcggacuccuucuucagccgccucaacuggcugaccaaguccggcaacucguacccgacgcugaacgugaccaugcccaacaacgacaacuucgacaagcucuacaucuggggcauccaccaccccuccaccaacaacgagcagaccaagcuguacguccaggagcuggggcgggugacggugucgaccaagcgcucccagcagaccaucauccccaacaucggcucgcggccggggguccgcggccaggccggccggaucagcaucuacuggaccaucgugaagcccggggacauccucaugaucaacuccaacggcaaccugguggcgccccgcggguacuucaagaugcggacgggcaagucguccaucaugcgcucggacgcccccaucgacacgugcugguccgagugcaucaccccgaacgggucgauccccaacgacaagcccuuccagaacgucaacaaggugaccuacggcaagugccccaaguacaucaagcagaacacccugaagcucgccaccggcaugcggaacgugccggagaagcagauccgcgggaucuucggcgccaucgccggguucaucgagaacggcugggaggggauggucgacggcugguacggcuuccgguaccagaacuccgaggggaccggccaggccgccgaccucaagagcacccaggccgcgaucgaccagaucaacgggaagcugaaccgcgugaucgagcggacgaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacaccaucgaccugaccgacgccgagaugaacaagcuguucgagaagacgcggcgccagcugcgcgagaacgccgaggacaugggcgggggcugcuucaagaucuaccacaagugcgacaacgcgugcaucggguccauccggaacggcaccuacgaccacuacaucuaccgcgacgaggcccugaacaaccgguuccagaucaaggggguggagcucaagucgggcuacaaggacuggauccuguggaucuccuucgccaucagcugcuuccugaucugcgucgugcuccugggcuucaucaugugggccugcgagaaggggaacauccgcugcaacaucugcaucuga

SEQ ID NO: 1181 - RNA, 1701 nt, Artificial Sequence
  derived and/or modified CDS sequence (AUadapt) from InfluenzaA__ABF60577__HA
augaagaccaucaucgugcugucguacuucuucugccucgcccugucccaggacuacagcgaguccaacaacucgaccgccacgcugugccucggccaccacgcgguccccaacgggaccaucgugaagaccaucaccgacgaccagaucgaggugacgaacgccaccgagcugguccaguccagcuccaccggcaagaucugcaacaacccgcaccgcauccuggacgggcgggacugcacccucaucgacgcccugcugggcgacccccacugcgacguguuccaggacgagacgugggaccucuacguggagcgcucguccgccuucagcaacugcuaccccuacgacguccccgacuacgccucccugcggucgcugguggcguccagcgggacccucgaguucaucaccgagggcuucaccuggacgggcgugacccagaacgggggcuccaacgccugcaagcgcgggccggccagcggcuucuucucccggcugaacuggcugaccaagucgggguccaccuaccccguccucaacgugacgaugcccaacgacgacaacuucgacaagcuguacguguggggcguccaccaccccagcaccaaccaggagcagaccgaccuguacgugcaggccucgggccgcgugaccgucuccacgcggcgcagccagcagaccaucaucccgaacaucgggucccggcccugggugcgcggccagucggggcggaucuccaucuacuggaccaucgugaagcccggcgacguccucgugaucaacagcaacggcaaccugaucgcgccccgcggguacuucaagauccggaccggcaaguccagcaucaugcgcuccgacgccccgaucgacacgugcaucucggagugcaucacccccaacggguccauccccaacgacaagcccuuccagaacgugaacaagaucaccuacggcgccugcccgaaguacgucaagcagagcacccugaagcucgccacggggaugcggaacgugcccgagaagaagacccgcggccuguucguggccaucgcgggcuucaucgagaacgggugggagggcaugaucgacugcugguacggguuccggcaccagaacuccgagggcaccgggcaggccgccgaccucaagucgacccaggccgccaucgaccagaucaacggcaagcugaaccgcgucaucgagaagacgaacgagaaguuccaccagaucgagaaggaguucuccgagguggagggccggauccaggaccuggagaacuacgucgaggacaccaagaucgaccuguggagcuacaacgcggagcuccugguggcccuggagaaccagcacaccaucgaccucaccgacuccgagaugaacaagcuguucgagcgcacgcggcgccagcugcgcgagaacgccgaggacauggggucgggcugcuucaagaucuaccacaagugcgacaacgccugcaucgaguccauccggaacgggaccuacgaccacgacaucuaccgcgacgaggcccucaacaaccgguuccagaucaagggcguggagcucaagagcggguacaaggacuggauccuguggaucagcuucgcgaccuccugcuuccugcugugcgucgugcugggcggcuucaucaugugggccugccagcgcgggaacauccggugcaacaucugcaucuga

SEQ ID NO: 1182 - RNA, 1701 nt, Artificial Sequence
  derived and/or modified CDS sequence (AUadapt) from InfluenzaA__ABF60578__HA
augaagaccaucaucgugcugucgugcuucuucugccucgccuucucccaggaccugucggagaacaacaacaacaccgccacgcugugccucggccaccacgcgguccccaacgggaccaucgugaagaccaucaccgacgaccagaucgaggugacgaacgccaccgagcugguccaguccagcuccaccggcaagaucugcaacaacccgcaccgcauccuggacgggcgggacugcacccucaucgacgcccugcugggcgacccccacugcgacguguuccaggacgagacgugggaccucuacguggagcgcucgaaguccuucagcaacugcuaccccuacgacguccccgacuacgccucccugcggucgcugguggccuccagcgggacccucgaguucaucaccgaggcguucaccuggacgggcgugacccagaacggcggguccggcgccugcaagcgcgggccgggcaacggguucuucucgcggcugaacuggcugaccaaguccggcagcgccuaccccguccucaacgugaccaugcccaacaacgacaacuucgacaagcuguacguguggggcguccaccaccccuccacgaaccaggagcagaccaaccuguacgugcaggccucggggcgcgugaccgucuccacccggcgcagccagcagacgaucaucccgaacaucggcucgcggcccugggugcgcgggcagucccggcgcaucagcaucuacuggaccaucgugaagcccggcgacauccucgucaucaacuccaacggcaaccugaucgcgccccggggguacuucaagaugcgcaccggcaagucguccaucaugcggagcgacgccccgaucgacacgugcaucuccgagugcaucacccccaacgggucgauccccaacgacaagcccuuccagaacgugaacaagaucaccuacggcgccugcccgaaguacaucaagcaguccacccugaagcucgccaccgggaugcgcaacgugcccgagaagcagacgcggggccuguucggcgccaucgcgggguucaucgagaacggcugggaggggaugaucgacggcugguacggguuccgccaccagaacagcgagggcaccggccaggccgccgaccugaaguccacccaggccgccaucgaccagaucaacgggaagcucaaccgggucaucgagaagaccaacgagaaguuccaccagaucgagaaggaguucucggagguggagggccgcauccaggaccuggagaaguacguggaggacacgaagaucgaccugugguccuacaacgcggacguccucguggcccuggagaaccagcacaccaucgaccugaccgacagcgagaugaacaagcuguucgagaagacccggcgccagcuccgcgagaacgccgaggacauggggaacggcugcuucaagaucuaccacaagugcgacaacgccugcaucgaguccauccggaacgggacguacgaccacgacaucuaccgcgacgaggcccugaacaaccgguuccagaucaagggcugcggcgucaagucgggguacaaggacuggauccucuggaucuccuucgcgaucagcugcuuccugcugugcguggugcuccugggcuucaucaugugggccugccagcgcgggaacauccggugcaacaucugcaucuga

SEQ ID NO: 1183 - RNA, 1701 nt, Artificial Sequence
  derived and/or modified CDS sequence (AUadapt) from InfluenzaA__ABF60579__HA
augaagacccugaucgcccucucguacaucuucugccuggugcugggccaggaccuccccgggaacggcaacuccaccgccacgcugugccuggggcaccacgcggucccgaacggcacccucgugaagaccaucaccgacgaccagaucgaggugacgaacgccaccgagcugguccagaacuucagcauggacaagaucugcaacaacccccaccgcauccuggacggggccaacugcacccucaucgacgcccugcugggcgacccccacugcgacgacuuccagaacgagaagugggaccucuucguggagcgguccaaggccuucucgaacugcuaccccuacgacgugccggacuacaccucccugcgcagccugaucgcguccucgggcacgcucgaguucaucaacgaggacuucaacuggaccggggucacccagaacggcggguccaacgccugcaagcggggccccgacagcuccuucuucucgcgccugaacuggcuguacaaguccgggaacaccuaccccaugcucaacgugacgaugcccaacagcgacaacuucgacaagcuguacaucuggggcgugcaccacccguccaccgcccgggagcagaccaaccuguacguccaggccucgggcaaggugaccguguccacgaagcgcagccagcagaccaucauccccaacaucgggucccggcccuggguccgcggccucucgagccggaucuccaucuacuggaccaucgugaagcccggggacauccuggugaucaacucgaacggcaaccugaucgcgccgcgcggcuacuucaagaugcacaccgggcgguccagcaucaugcgcuccgacgcccccaucgacacgugcucguccgagugcaucacccccaacggcagcauccccaacgacaagccguuccagaacgucaacaagaucaccuacggggccugccccaaguacgugaagcagaacacccucaagcuggccacgggcaugcggaacauccccgagaagcagacccgcgggaucuucggcgccaucgcgggcuucaucgagaacgggugggagggcaugguggacgggugguacggcuuccggcaccagaacuccgaggggaccggccaggccgccgaccucaagucgacccaggccgccaucgaccagaucaacggcaagcugaaccgcgucaucgagaagacgaacgagaaguuccaccagaucgagaaggaguucuccgggguggagggccggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgccggcagcugcgcgagaacgccgaggacauggggaacggcugcuucaagaucuaccacaagugcgacaacgccugcaucgagucgauccggaacgggaccuacgaccacaacgaguaccgcgacgaggcccucaacaaccgcuuccagaucaagggcguggagcugaaguccggcuacaaggacuggauccuguggaucagcuucgcgaucuccugcuuccuccugugcgugguccugcucggguucaucaugugggccugccagaagggcaacauccggugcaacaucugcaucuga

SEQ ID NO: 1184 - RNA, 1701 nt, Artificial Sequence
  derived and/or modified CDS sequence (AUadapt) from InfluenzaA__ABF60580__HA
augaagaccaucaucgcccugucguacaucuucugccucgccuucgcgcaggaccugcccggcaacgacaacuccaccgccacgcugugccucgggcaccacgccgugccgaacggcacccuggucaagaccaucaccaacgaccagaucgaggugacgaacgccaccgagcuggugcagucguccagcaccgggaagaucugcgacaacccccaccgcauccucgacggcaucaacugcacccugaucgacgcccugcucggggacccccacugcgacggcuuccagaacgagaagugggaccuguucgucgagcgguccaaggcguucucgaacugcuaccccuacgacgugccggacuacgccucccugcgcucgcucguggccuccagcggcacgcuggaguucaucaacgagggguucaacuggaccggcgucacccagaacgggggcuccucggccugcaagcgggggcccgacaacggcuucuucucccgccugaacuggcucuacaagucgggcuccaccuaccccgugcagaacgugacgaugcccaacaacgacaacagcgacaagcuguacaucuggggcguccaccacccguccaccgacaaggagcagaccgaccuguacgugcaggcgucggggaaggugaccgucuccacgaagcggauccagcagaccgugauccccaacguggggucgcgccccuggguccggggccucagcucccgcgugucgaucuacuggaccaucgugaagcccggcgacguccuggugaucaacuccaacgggaaccugaucgccccgcggggcuacuacaagaugcgcaccggcaagucguccaucaugcggagcgacgcccccaucgggacgugcuccucggagugcaucacccccaacggguccauccccaacgacaagccguuccagaacgugaacaagaucaccuacggcgccugccccaaguacgucaagcagaacacccucaagcuggccacgggcaugcgcaacgugcccgagaagcagacccgggggaucuucggcgcgaucgccggguucaucgagaacggcugggaggggaugaucgacggcugguacggcuuccgccaccagaacucggaggggaccggccaggccgccgaccugaaguccacccaggccgcgaucgaccagaucaacgggaagcucaaccgggugaucgagaagacgaacgagaaguuccaccagaucgagaaggaguucagcgaggucgagggccgcauccaggaccuggagaaguacguggaggacaccaagaucgaccugugguccuacaacgccgagguccucguggcccuggagaaccagcacaccaucgaccugaccgacucggagaugaacaagcuguucgagaagacgcggcgccagcuccgggagaacgccgaggacauggggaacggcugcuucaagaucuaccacaagugcgacaacgccugcaucggcuccauccgcaacgggaccuacgaccacgacguguaccgggacgaggcgcugaacaaccgcuuccagaucaagggcgucgagcucaagucgggguacaaggacuggauccuguggaucuccuucgccaucagcugcuuccugcucugcguggugcugcugggcuucaucaugugggccugccagaagggcaacauccgcugcaacaucugcaucuga

SEQ ID NO: 1185 - RNA, 1701 nt, Artificial Sequence
  derived and/or modified CDS sequence (AUadapt) from InfluenzaA__ABF60581__HA
augaagaccaucaucgugcugucguacuucuucugccucgcccugucccaggacuacagcgaguccaacaacucgaccgccacgcugugccucggccaccacgcgguccccaacgggaccaucgugaagaccaucaccgacgaccagaucgaggugacgaacgccaccgagcugguccaguccagcuccaccggcaagaucugcaacaacccgcaccgcauccuggacgggcgggacugcacccucaucgacgcccugcugggcgacccccacugcgacguguuccaggacgagacgugggaccucuacguggagcgcucguccgccuucagcaacugcuaccccuacgacguccccgacuacgacucccugcggucgcugguggccuccagcgggacccucgaguucaucaccgagggcuucaccuggacgggcgugacccagaacgggggcuccaacgcgugcaagcgcgggccggccucgggcuucuucucccggcugaacuggcugaccaagagcggguccaccuaccccguccucaacgugacgaugcccaacaacgacaacuucgacaagcuguacguguggggcguccaccaccccagcaccaaccaggagcagaccaaccuguacgugcaggccucgggccgcgugaccgucuccacgcggcgcagccagcagaccaucaucccgaacaucgggucccggcccugggugcgcggccagucggggcggaucuccaucuacuggaccaucgugaagcccggcgacguccucgugaucaacagcaacggcaaccugaucgcgccccgcggguacuucaagaugcggaccggcaaguccucgaucaugcgcuccgacgccccgaucgacacgugcaucagcgagugcaucacccccaacggguccauccccaacgacaugcccuuccagaacgugaacaagaucaccuacggcgccugcccgaaguacgucaagcaggggacccugaagcucgccacgggcaugcggaacgugcccgagaagcagacccgcggccuguucggggccaucgccggcuucaucgagaacgggugggagggcaugaucgacgggugguacggcuuccggcaccagaacucggagggcaccgggcaggcggccgaccugaaguccacccaggccgccaucgaccagaucaacggcaagcucaaccgcgugaucgagaagacgaacgagaaguuccaccagaucgagaaggaguucagcgaggucgaggggcggauccaggaccuggagaaguacguggaggacaccaagaucgaccugugguccgacaacgccgagcuccuggucgcgcuggagaaccagcacaccaucgaccucaccgacucggagaugaacaagcuguucgagaagacgcgccggcagcugcgcgagaacgccgaggugaugggcaacgggugcuucaagaucuaccacaagugcgacaacgccugcaucgaguccauccgcaacggcaccuacgaccacgacaucuaccgggacgaggcccucaacaaccgcuuccagaucaagggcguggagcucaagagcggguacaaggacuggauccuguggaucuccuucgccaucagcugcuuccugcugugcgucgugcugcucggcuucaucaugugggcgugccagcgggggaacauccgcugcaacaucugcaucuga

SEQ ID NO: 1186 - RNA, 1701 nt, Artificial Sequence; identical to SEQ ID NO: 985
  derived and/or modified CDS sequence (AUadapt) from InfluenzaA__ABF82651__HA

SEQ ID NO: 1187 - RNA, 1698 nt, Artificial Sequence; identical to SEQ ID NO: 1045
  derived and/or modified CDS sequence (AUadapt) from InfluenzaA__ABF82662__HA

SEQ ID NO: 1188 - RNA, 1698 nt, Artificial Sequence
  derived and/or modified CDS sequence (AUadapt) from InfluenzaA__ABF82673__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagggcuccuggagcuacaucgucgagacccccaaccccgagaacggcacgugcuaccccggguacuucgccgacuacgaggagcugcgcgagcagcucuccagcguguccagcuucgagcgguucgagaucuucccgaagggcuccucguggcccaaccacaccgugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggcuucgggagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccggggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacggcucccugcagugccgcaucugcaucuga

SEQ ID NO: 1189 - RNA, 1698 nt, Artificial Sequence; identical to SEQ ID NO: 1086
  derived and/or modified CDS sequence (AUadapt) from InfluenzaA__ABF82684__HA

SEQ ID NO: 1190 - RNA, 1701 nt, Artificial Sequence; identical to SEQ ID NO: 1052
  derived and/or modified CDS sequence (AUadapt) from InfluenzaA__ABF82695__HA

SEQ ID NO: 1191 - RNA, 1701 nt, Artificial Sequence; identical to SEQ ID NO: 1028
  derived and/or modified CDS sequence (AUadapt) from InfluenzaA__ABF82706__HA

SEQ ID NO: 1192 - RNA, 1698 nt, Artificial Sequence; identical to SEQ ID NO: 544
  derived and/or modified CDS sequence (AUadapt) from InfluenzaA__ABF82819__HA

SEQ ID NO: 1193 - RNA, 1698 nt, Artificial Sequence; identical to SEQ ID NO: 1045
  derived and/or modified CDS sequence (AUadapt) from InfluenzaA__ABF82830__HA

SEQ ID NO: 1194 - RNA, 1698 nt, Artificial Sequence; identical to SEQ ID NO: 1045
  derived and/or modified CDS sequence (AUadapt) from InfluenzaA__ABF82841__HA

SEQ ID NO: 1195 - RNA, 1698 nt, Artificial Sequence; identical to SEQ ID NO: 1045
  derived and/or modified CDS sequence (AUadapt) from InfluenzaA__ABF82852__HA

SEQ ID NO: 1196 - RNA, 1698 nt, Artificial Sequence
  derived and/or modified CDS sequence (AUadapt) from InfluenzaA__ABF82863__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagucguccuucuaccgcaaccugcuguggcucaccgggaagaacgggcuguaccccaaccugagcauguucuacgugaacaacaaggagaaggaggugcucguccuguggggcgugcaccacccgcccaacaucggcgaccagcgggcccuguaccacacggagaacgccuacguguccgucgugagcagccacuacucccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucagccggggcuucggcuccgggaucaucacgagcaacgcccccaugggcgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggcgccaucgccggguucaucgagggcggguggaccggcaugguggacgggugguacggcuaccaccaccagaacgagcagggcucgggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacaacgagugcauggaguccgugaagaacggcaccuacgacuaccccaaguacagcgaggaguccaagcucaaccgggagaagaucgacggggugaagcuggagagcaugggcgucuaccagauccuggccaucuacuccacgguggccagcagccucgugcugcuggucucccucggggccaucagcuucuggaugugcuccaacggcagccugcagugccgcaucugcaucuga

SEQ ID NO: 1197 - RNA, 1698 nt, Artificial Sequence
  derived and/or modified CDS sequence (AUadapt) from InfluenzaA__ABF82874__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagucguccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagucgcggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaucaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1198 - RNA, 1698 nt, Artificial Sequence; identical to SEQ ID NO: 1045
  derived and/or modified CDS sequence (AUadapt) from InfluenzaA__ABF82885__HA

SEQ ID NO: 1199 - RNA, 1698 nt, Artificial Sequence; identical to SEQ ID NO: 1045
  derived and/or modified CDS sequence (AUadapt) from InfluenzaA__ABF82896__HA

SEQ ID NO: 1200 - RNA, 1698 nt, Artificial Sequence; identical to SEQ ID NO: 1045
  derived and/or modified CDS sequence (AUadapt) from InfluenzaA__ABF82907__HA

SEQ ID NO: 1201 - RNA, 1698 nt, Artificial Sequence; identical to SEQ ID NO: 1089
  derived and/or modified CDS sequence (AUadapt) from InfluenzaA__ABF82929__HA

SEQ ID NO: 1202 - RNA, 1698 nt, Artificial Sequence; identical to SEQ ID NO: 1045
  derived and/or modified CDS sequence (AUadapt) from InfluenzaA__ABF82940__HA

SEQ ID NO: 1203 - RNA, 1701 nt, Artificial Sequence
  derived and/or modified CDS sequence (AUadapt) from InfluenzaA__ABF83447__HA
augaagaccaucaucgcccugucguacaucuucugccucgcccugggccaggaccugcccgggaacgacaacaacaccgcgacgcucugccugggccaccacgccgugccgaacgggacccuggucaagaccaucaccgacgaccagaucgaggugacgaacgccaccgagcucgugcaguccucguccaccggcaagaucugcaacaacccccaccgcauccuggacgggaucgacugcacccugaucgacgcccuccugggcgacccccacugcgacgucuuccagaacgagacgugggaccuguucguggagcggagcaaggccuucuccaacugcuaccccuacgacgugccggacuacgcgucgcuccgcucccuggucgccagcuccggcacccuggaguucaucaccgagggguucaccuggacgggcgugacccagaacgggggcucgaacgccugcaagcgggggcccggcuccggcuucuucagccgccucaacuggcugaccaaguccgggucgaccuaccccgugcugaacgucacgaugcccaacaacgacaacuucgacaagcucuacaucuggggcgugcaccacccguccaccaaccaggagcagaccagccuguacgugcaggccuccgggggcgucaccgugucgacgcggcgcucccagcagaccaucauccccaacaucggcucgcggcccugggugcgcgggcugagcucccggaucucgaucuacuggaccaucgucaagcccggcgacgugcucgugaucaacuccaacgggaaccugaucgcgccgcgcggcuacuucaagaugcggaccggcaagagcuccaucaugcgcucggacgcccccaucgacacgugcaucuccgagugcaucacccccaacgggagcauccccaacgacaagccguuccagaacgucaacaagaucaccuacggcgccugccccaaguacgugaagcagaacacccugaagcucgccacggggaugcggaacgugcccgagaagcagacccgcggccuguucggggccaucgcgggcuucaucgagaacgggugggagggcaugaucgacggcugguacggguuccggcaccagaacuccgagggcaccgggcaggccgccgaccucaagucgacccaggccgccaucgaccagaucaacggcaagcugaaccgcgucaucgagaagacgaacgagaaguuccaccagaucgagaaggaguucuccgagguggaggggcggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgccggcagcugcgcgagaacgccgaggacaugggcaacggcugcuucaagaucuaccacaagugcgacaacgccugcaucgagucgauccggaacgggaccuacgaccacgacguguaccgcgacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagcggggcaacauccgcugcaacaucugcaucuga

SEQ ID NO: 1204 - RNA, 1644 nt, Artificial Sequence
  derived and/or modified CDS sequence (AUadapt) from InfluenzaA__ABG20468__HA
auggagaagaucgugcugcuccuggccaucgucagucuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggggagaagaucaacccggccaacgaccugugcuaccccggcaacuucaacgacuacgaggagcucaagcaccuccugucgcggaucaaccacuucgagaagauccagaucauccccaaguccucgugguccgaccacgaggccucguccggggugucguccgccugccccuaucagggccgcucguccuucuuccggaacguggucuggcugaucaagaagaacaacgcguacccgaccaucaagcgcucguacaacaacacgaaccaggaggaccugcuggugcucuggggcauccaccaccccaacgacgccgccgagcagacccggcuguaccagaaccccaccaccuacaucuccguggggacgucgacccugaaccagcgccucguccccaagaucgccacccgguccaaggugaacggccagucggggcgcauggaguucuucuggaccauccugaagccgaacgacgcgaucaacuucgaguccaacggcaacuucaucgcccccgagaacgccuacaagaucgugaagaagggggacucgacgaucaugaaguccgagcuggaguacggcaacuguaacaccaagugcgagacccccaucggcgccaucaacucgucgaugcccuuccacaacauccacccgcucaccaucggggagugccccaaguacgucaaguccaaccggcuggugcuggccacgggccuccgcaacucgccccagggggagcggcgccggaagaagcgcggccuguucggcgcgaucgccggguucaucgagggcggguggcagggcaugguggacgggugguacggcuaccaccacuccaacgagcagggcucgggguacgccgccgacaaggaguccacccagaaggccaucgacggcgucaccaacaaggugaacucgaucaucgacaagaugaacacccaguucgaggcgguggggcgggaguucaacaaccuggagcgccggaucgagaaccucaacaagaagauggaggacggcuuccuggaugucuggacguacaacgccgagcugcucgugcugauggagaacgagcgcacccuggacuuccacgacuccaacgugaagaaccucuacgacaagguccggcugcagcugcgcgacaacgccaaggagcucgggaacggcugcuucgaguucuaccaccggugcgacaacgagugcauggagucggugcgcaacggcaccuacgacuacccccaguacuccgaggaggcccgccugaagcgggaggagaucucgggggucaagcuggaguccaucggcaccuaccagauccucucgaucuacuccacgguggccucgucccuggcgcuggccaucaugguggccgggcucucgcuguggaugugcuccaacggcucgcugcagugccgcaucugcaucuga

SEQ ID NO: 1205 - RNA, 1707 nt, Artificial Sequence
  derived and/or modified CDS sequence (AUadapt) from InfluenzaA__ABG20472__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaaggcccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccucgggcgucuccagcgcgugcccguaccagggccgcuccucguucuuccggaacgugguguggcugaucaagaaggacaacgccuaccccaccaucaagcgcuccuacaacaacaccaaccaggaggaccugcugguccucugggggauccaccaccccaacgacgccgccgagcagacgcggcuguaccagaacccgaccaccuacaucucggugggcaccuccacgcugaaccagcgccucgugcccaagaucgcgacccggagcaaggucaacgggcaguccggccgcauggaguucuucuggaccauccugaagcccaacgacgccaucaacuucgagucgaacgggaacuucaucgcccccgagaacgccuacaagaucgugaagaagggcgacagcaccaucaugaaguccgagcuggaguacggcaacugcaacacgaagugccagaccccgaucggggccaucaacucguccaugcccuuccacaacauccacccccucaccaucggcgagugccccaaguacgucaagagcaaccggcuggugcuggcgaccgggcuccgcaacuccccgcagggcgagcggcgccggaagaagcgcggccuguucggggccaucgccggcuucaucgagggcggguggcaggggaugguggacggcugguacggcuaccaccacucgaacgagcagggguccggcuacgccgccgacaaggagucgacgcagaaggcgaucgacggggugaccaacaaggucaacuccaucaucgacaagaugaacacccaguucgaggccgugggccgggaguucaacaaccuggagcgccggaucgagaaccucaacaagaagauggaggacggguuccuggacguguggaccuacaacgccgagcugcucguccugauggagaacgagcgcacgcuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacucggaggaggcccgccugaagcgggaggagaucuccggcgugaagcuggagagcaucgggaccuaccagauccucuccaucuacucgaccgucgcguccagccuggcccuggccaucaugguggccggccucucccuguggaugugcucgaacgggagccugcagugccgcaucugcaucuga

SEQ ID NO: 1206 - RNA, 1707 nt, Artificial Sequence
  derived and/or modified CDS sequence (AUadapt) from InfluenzaA__ABG20478__HA
auggagaagaucgugcuccuguucgccaucgucucgcuggugaaguccgaccagaucugcaucggcuaccacgccaacaacucgaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucauccccaagucguccuggagcgaccacgaggccuccucgggcgucuccagcgccugcccguaccagggccgcuccucguucuuccggaacgugguguggcugaucaagaaggacaacgcguaccccaccaucaagcgcuccuacaacaacacgaaccaggaggaccuccugguccugugggggauccaccaccccaacgacgccgccgagcagacccggcucuaccagaacccgaccaccuacaucagcgugggcacguccacccugaaccagcgccuggugcccaagaucgccacccggucgaaggucaacgggcaguccggccgcauggaguucuucuggaccauccucaagcccaacgacgcgaucaacuucgagagcaacgggaacuucaucgcccccgagaacgccuacaagaucgugaagaagggcgacucgacgaucaugaaguccgagcuggaguacggcaacugcaacaccaagugccagaccccgaucggggccaucaacagcuccaugcccuuccacaacauccacccccugaccaucggcgagugccccaaguacgucaagucgaaccggcucgugcuggccacggggcugcgcaacuccccgcagggcgagcggcgccggaagaagcgcggccucuucggggcgaucgccggcuucaucgagggcggguggcaggggaugguggacggcugguacggcuaccaccacagcaacgagcagggguccggcuacgccgccgacaaggagucgacccagaaggccaucgacggggugaccaacaaggucaacuccaucaucgacaagaugaacacccaguucgaggcggugggccgggaguucaacaaccuggagcgccggaucgagaaccugaacaagaagauggaggacggguuccucgacguguggacguacaacgccgagcugcugguccucauggagaacgagcgcacccuggacuuccacgacagcaacgugaagaaccuguacgacaagguccggcuccagcugcgcgacaacgccaaggagcugggcaacggcugcuucgaguucuaccaccggugcgacaacgagugcauggaguccgugcgcaacgggaccuacgacuacccccaguacucggaggaggcccgccucaagcgggaggagaucuccggcgugaagcuggagagcaucgggaccuaccagauccuguccaucuacucgacggucgccuccagccucgcgcuggccaucaugguggccggccugucccucuggaugugcucgaacgggagccugcagugccgcaucugcaucuga

SEQ ID NO: 1207 - RNA, 1701 nt, Artificial Sequence; identical to SEQ ID NO: 1028
  derived and/or modified CDS sequence (AUadapt) from InfluenzaA__ABG26758__HA

SEQ ID NO: 1208 - RNA, 1701 nt, Artificial Sequence
  derived and/or modified CDS sequence (AUadapt) from InfluenzaA__ABG26769__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggucgcuggucgccuccagcggcacgcuggaguucaacaacgaguccuucaacuggaccgggguggcccagaacggcaccucguacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccucgacggacuccgaccagaccagccuguacgugcaggccuccgggcgggucaccgugucgaccaagcgcagccagcagacggugaucccgaacaucggguccggccccuggguccggggcgugucgucccgcaucagcaucuacuggaccaucgugaagcccggggacauccuccugaucaacuccaccggcaaccugaucgcgccccggggguacuucaagauccgcucgggcaaguccagcaucaugcgguccgacgccccgaucggcaacugcaacucggagugcaucacccccaacggguccauccccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacggcugggaggggauggucgacggcugguacggguuccgccaccagaacagcgagggcacggggcaggccgccgaccugaaguccacccaggcggccaucaaccagaucaacggcaagcucaaccggcugaucgagaagaccaacgagaaguuccaccagaucgagaaggaguucucggagguggagggccgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgccgaggacauggggaacggcugcuuccggaucuaccacaagugcgacaacgcgugcaucggguccauccgcaacggcaccuacgaccacgacguguaccgggacgaggcccugaacaaccgcuuccagaucaagggggucgagcucaagucgggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 1209 - RNA, 1701 nt, Artificial Sequence; identical to SEQ ID NO: 1156
  derived and/or modified CDS sequence (AUadapt) from InfluenzaA__ABG26780__HA

SEQ ID NO: 1210 - RNA, 1701 nt, Artificial Sequence
  derived and/or modified CDS sequence (AUadapt) from InfluenzaA__ABG26791__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcucaaggagcagcugagcuccgucagcuccuucgagcgguucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgcgccaucuaccacaccgagaacgcguacgugagcguggucuccagccacuacucccggcgcuucaccccggagaucgccaagcggcccaaggugcgcgaccaggagggccggaucaacuacuacuggacccuccuggagcccggcgacacgaucaucuucgaggccaacgggaaccugaucgcccccugguacgccuucgcgcucucgcgcggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcggucgacgaagcugcgcauggugaccgggcuccggaacaucccguccauccagagccgcggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcggcgcauggagaaccucaacaagaaggucgacgacggcuuccuggacaucuggaccuacaacgcggagcugcucgugcugcuggagaacgagcggacgcucgacuuccacgacucgaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgcgagaagaucgacggcgucaagcuggagagcaugggcguguaccagauccuggccaucuacucgaccguggccuccagccucguccugcuggugucccucggggccaucagcuucuggaugugcuccaacggcagccugcagugccggaucugcaucuga

SEQ ID NO: 1211 - RNA, 1701 nt, Artificial Sequence
  derived and/or modified CDS sequence (AUadapt) from InfluenzaA__ABG26802__HA
augaagaccaucaucgcccugucguacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucucgaacugcuaccccuacgacgugccggacuacgcgucccugcggagccucgucgccuccucgggcacgcuggaguucaucaacgagggguucaacuggaccggcgugacccaguccgggggcagcuacgccugcaagcgcggguccgugaacucguucuucucccggcugaacuggcucuacgagagcgaguccaaguaccccgcccugaacgucaccaugcccaacaacggcaaguucgacaagcuguacaucuggggcgugcaccaccccucgacggacaaggagcagaccaaccucuacgugcgcgcgagcgggcgggucaccguguccaccaagcgcucgcagcagacggugaucccgaacaucggcccccggcccuggguccgcgggcuguccagccggaucuccaucuacuggaccaucgugaagcccggcgacauccugcucaucaacucgaccggcaaccugaucgccccgcgcggguacuucaagauccggaccggcaaguccagcaucaugcgcuccgacgcccccaucgggacgugcucguccggcugcaucacccccaacgggagcauccccaacgacaagccguuccagaacgugaacaagaucaccuacggcgccugcccccgguacgucaagcagaacacccugaagcucgccacgggcaugcgcaacgugcccgagaagcagacccgggggaucuucggcgcgaucgccggguucaucgagaacggcugggaggggaugguggacggcugguacggcuuccgccaccagaacuccgaggggaccggccaggccgccgaccucaagucgacccaggccgcgaucgaccagaucaacgggaagcugaaccggcucaucgagaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgacaugaccgacuccgagaugaacaagcuguucgagaagacgcggaagcagcugcgcgagaacgccgaggacauggggaacggcugcuucaagaucuaccacaagugcgacaacgccugcaucggcucgauccgcaacgggaccuacgaccacgacgucuaccgggacgaggcgcugaacaaccgcuuccagaucaagggcguggagcucaaguccggguacaaggacuggauccuguggaucagcuucgccaucagcugcuuccugcucugcgucgugcugcugggcuucaucaugugggccugccagaagggcaacauccggugcaacaucugcaucuga

SEQ ID NO: 1212 - RNA, 1701 nt, Artificial Sequence; identical to SEQ ID NO: 1160
  derived and/or modified CDS sequence (AUadapt) from InfluenzaA__ABG26813__HA

SEQ ID NO: 1213 - RNA, 1701 nt, Artificial Sequence
  derived and/or modified CDS sequence (AUadapt) from InfluenzaA__ABG26824__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggucguacaucgccgagacccccaacagcgagaacgggaccugcuaccccggcuacuucgccgacuacgaggagcugcgcgagcagcuguccagcguguccucguucgagcgguucgagaucuuccccaaggaguccagcuggccgaagcacaacgucaccaagggggugacggccuccugcagccacaagggcaaguccucguucuaccgcaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucucggugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgucgauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggucgggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacucggaggagagcaagcucaaccgcgagaagaucgacggcgugaagcuggaguccauggggguguaccagauccuggccaucuacagcaccgucgccuccucgcucgugcugcuggugucccucggcgccaucagcuucuggaugugcuccaacggcagccugcagugcaagaucugcaucuga

SEQ ID NO: 1214 - RNA, 1701 nt, Artificial Sequence; identical to SEQ ID NO: 1166
  derived and/or modified CDS sequence (AUadapt) from InfluenzaA__ABG26835__HA

SEQ ID NO: 1215 - RNA, 1701 nt, Artificial Sequence
  derived and/or modified CDS sequence (AUadapt) from InfluenzaA__ABG26890__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucgcccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgucgcuccggucccuggucgccagcuccggcacgcuggaguucaccaacgagaacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccacccgucgacggacuccgaccagaccagccuguacgugcgcgccuccgggaaggucaccgugucgaccaagcggucccagcagacggugauccccgacaucggcuaccgccccuggguccgggggcucucgagccgcaucuccaucuacuggaccaucgugaagcccggcgacauccugcugaucaacucgaccgggaaccucaucgccccgcggggcuacuucaagauccgcaacggcaaguccagcaucaugcgguccgacgcccccaucgggaacugcucguccgagugcaucacccccaacggcagcauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 1216 - RNA, 1701 nt, Artificial Sequence
  derived and/or modified CDS sequence (AUadapt) from InfluenzaA__ABG26901__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucgcccaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuacccguacgacgugcccgacuacgcgagccuccggucccuggucgccucguccggcacgcuggaguucaccaacgagaacuucaacuggaccgggguggcccaggacggcaagagcuacuccugcaagcgcgggucggugaacuccuucuucagccggcucaacuggcugcacaaguccgaguacaaguaccccgcccugaacgucaccaugcccaacaacggcaaguucgacaagcucuacaucuggggcgugcaccacccgucgacggacuccgaccagaccagccuguacgugcgcgcguccgggaaggucaccgugucgaccaagcggagccagcagacggugauccccgacaucggcuaccgccccuggguccgggggcuguccucgcgcaucuccaucuacuggaccaucgugaagcccggcgacauccuccugaucaacagcaccgggaaccugaucgccccgcggggcuacuucaagauccgcaacggcaaguccucgaucaugcgguccgacgcccccaucgggaacugcagcuccgagugcaucacccccaacggcucgauccccaacgacaagccguuccagaacgugaaccgcaucacguacggggccugcccccgguacgucaagcagaacacccucaagcuggccaccggcaugcgcaacgugcccgagaagcagacccgggggaucuucggcgcgaucgccggcuucaucgagaacgggugggagggcaugguggacgggugguacggcuuccgccaccagaacuccgaggggacgggccaggccgccgaccugaaguccacccaggccgcgaucgaccagaucaacggcaagcucaaccggcuggucgagaagaccaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgccugcaucggcucgauccggaacgggaccuacgaccacgacguguaccgcgacgaggcgcugaacaaccgguuccagaucaagggcgucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 1217 - RNA, 1701 nt, Artificial Sequence
  derived and/or modified CDS sequence (AUadapt) from InfluenzaA__ABG26912__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagauccgcaacggcaagucguccaucaugcggagcgacgccccgaucuccaacugcaacucggagugcaucacccccaacggguccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccugaaguccacccaggcggccaucgaccagaucaacggcaagcucaaccggcugaucgagaagaccaacgagaaguuccaccagaucgagaaggaguucucggaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagucgggcuacaaggacuggauccuguggaucuccuucgccaucagcugcuuccugcugugcgucgugcuccugggcuucaucaugugggccugccagaaggggaacauccgcugcaacaucugcaucuga

SEQ ID NO: 1218 - RNA, 1698 nt, Artificial Sequence
  derived and/or modified CDS sequence (AUadapt) from InfluenzaA__ABG26945__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcguccgggaaccugaucgccccgugguacgccuucgcccucucgcggggcuucggcuccgggaucaucacgagcaacgcccccaugggcgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggcgccaucgccggguucaucgagggcggguggaccggcaugguggacgggugguacggcuaccaccaccagaacgagcagggcagcggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagucgcagcugaagaacaacgcgaaggagaucgggaacggcugcuucgaguucuaccacaagugcaacaacgagugcauggaguccgugaagaacggcaccuacgacuaccccaaguacagcgaggaguccaagcucaaccgggagaagaucgacggggugaagcuggagagcaugggcgucuaccagauccuggccaucuacagcacgguggccuccagccucgugcugcuggucucccucggggccaucagcuucuggaugugcuccaacggcagccugcagugccgcaucugcaucuga

SEQ ID NO: 1219 - RNA, 1701 nt, Artificial Sequence
  derived and/or modified CDS sequence (AUadapt) from InfluenzaA__ABG26956__HA
augaagaccaucaucgcccugucguacauccucugccugguguucgcccagaagcugcccggcaacgacaaccgcaccgcgacgcucugccuggggcaccacgccgucccgaacggcacccuggugaagaccaucaccaacgaccagaucgaggugacgaacgccaccgagcucguccaguccucguccaccgggcggaucugcgacagcccccaccagauccuggacggcgagaacugcacccugaucgacgcccuccugggggacccccacugcgacggcuuccagaacaaggagugggaccuguucguggagcgcuccaaggccuacucgaacugcuaccccuacgacgugccggacuacgucucccuccggagccugguggcguccucgggcacgcuggaguucaacaacgaguccuucaacuggaccgggguggcccagaacggcaccagcuccgccugcaagcgccggucggacaaguccuucuucagcaagcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccuccgggcgcgugaccgucagcaccaagcggucgcagcagaccgugaucccgaacaucggcucccgccccugggugcggggcgucucgucccgcaucagcaucuacuggacgaucgugaagcccggggacauccuccugaucaacuccaccggcaaccugaucgcgccccggggguacuucaagauccgcucgggcaaguccagcaucaugcgguccgacgccccgaucggcaagugcaacucggagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucucggagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagucgggcuacaaggacugggugcuguggaucuccuucgccaucagcugcuuccugcugugcaucguccuccugggcuucaucaugugggccugccagaaggggaacauccggugcaacaucugcaucuga

SEQ ID NO: 1220 - RNA, 1698 nt, Artificial Sequence
  derived and/or modified CDS sequence (AUadapt) from InfluenzaA__ABG37120__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggggagagcuccuucuaccgcaaccugcuguggcucaccggcaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1221 - RNA, 1701 nt, Artificial Sequence
  derived and/or modified CDS sequence (AUadapt) from InfluenzaA__ABG37131__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacggcccccaccagauccucgacgggaagaacugcacccugaucgacgcccugcucggcgacccccacugcgacggcuuccagaacaaggagugggaccuguucguggagcggucgaaggccuacuccaacugcuaccccuacgacgugccggacuacgcgagccugcgcucccucgucgccucguccgggacgcuggaguucaccaacgagagcuucaacuggaccggcguggcccagaacgggaccuccuacgccugcaagcggggcucggugaaguccuucuucucgcgccugaacuggcuccacaagcuggaguacaaguaccccgcgcugaacgucacgaugcccaacaacgacaaguucgacaagcucuacaucuggggcgugcaccaccccuccaccgacagcgaccagaccucccuguacgugcagucgagcgggcgggucaccguguccacgaagcgcucgcagcagaccgugaccccgaacaucggcucccggcccuggguccgcgggaucagcucccggaucucgaucuacuggaccaucgugaagcccggcgacauccugcucaucaacuccacggggaaccugaucgcgccccgcggcuacuucaagauccggcgcggcaagucguccaucaugcggagcgacgccccgaucgacaacugcaacuccgagugcaucacccccaacgggucgauccccaacgacaagcccuuccagaacgugaaccgcaucaccuacggcgccugcccgcgguacgucaagcagaacacccugaagcucgccacggggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacccaggccgcgaucaaccagaucaacggcaagcugaaccggcugaucgagaagacgaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacaccaucgaccucaccgacuccgagaugaacaagcuguucgagcggacgcgcaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaaggggguggagcugaaguccggcuacaaggacuggauccuguggaucucguucgccaucagcugcuuccuccugugcgucgugcugcucggcuucaucaugugggccugccagaaggggaacauccgcugcaacaucugcaucuga

SEQ ID NO: 1222 - RNA, 1701 nt, Artificial Sequence; identical to SEQ ID NO: 1028
  derived and/or modified CDS sequence (AUadapt) from InfluenzaA__ABG37142__HA

SEQ ID NO: 1223 - RNA, 1701 nt, Artificial Sequence
  derived and/or modified CDS sequence (AUadapt) from InfluenzaA__ABG37164__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacgacuuccagaacaaggagugggaccuguucguggagcgcagcaaggccuacuccaacugcuaccccuacgacgugccggacuacgcgucgcuccggucccuggucgccagcuccggcacgcuggaguucaccaaggagggcuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccggggcaucucgucccgcaucagcaucuacuggaccaucgugaagcccggggacauccuccugaucaacuccaccggcaaccugaucgcgccccggggguacuucaagauccgcaacggcaagucguccaucaugcggagcgacgccccgaucggcaacugcaacuccgagugcaucacccccaacgggucgauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccugaaguccacccaggcggccaucgaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 1224 - RNA, 1701 nt, Artificial Sequence
  derived and/or modified CDS sequence (AUadapt) from InfluenzaA__ABG37175__HA
augaagaccaucaucgcccugucguacauccucugccagguguucgccaagaagcugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaccaacgagggguucaacuggaccggcguggcccaggacgggaaguccuacuccugcaagcgcggcucggugaacuccuucuucagccggcugaacuggcuccacaagcuggaguacaaguaccccgcccugaacgucaccaugcccaacaacgacaaguucgacaagcucuacaucuggggcgugcaccaccccuccacggacucggaccagaccucccuguacgugcaggcgagcgggcgcgucaccgugucgaccaagcggucccagcagacggugaucccgaacaucggcucgcgccccuggguccgggggaucuccagccgcaucuccaucuacuggaccaucgugaagcccggcgacauccugcucaucaacucgaccgggaaccugaucgcgccccggggcuacuucaagauccgcaacggcaaguccagcaucaugcgguccgacgccccgaucgacaacugcaacucggagugcaucacccccaacggguccauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccugaaguccacccaggccgcgaucgaccagaucaacggcaagcugaaccggcucaucgagaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggacccgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaaggggguggagcucaagucgggcuacaaggacuggauccuguggaucuccuucgccaucagcugcuuccugcugugcgucgugcugcucggcuucaucaugugggccugccagaaggggaacauccgcugcaacaucugcaucuga

SEQ ID NO: 1225 - RNA, 1701 nt, Artificial Sequence
  derived and/or modified CDS sequence (AUadapt) from InfluenzaA__ABG37186__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaccaacgagggguucaacuggaccggcguggcccaggacgggaaguccuacgccugcaagcgcggcuccgugaacagcuucuucucccggcugaacuggcuccacaagcuggaguacaaguaccccgcgcugaacgucaccaugcccaacaacgacaaguucgacaagcucuacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccugcucaucuccucgaccgggaaccugaucgcgccccggggcuacuucaagauccgcaacggcaaguccagcaucaugcgguccgacgccccgaucgacaacugcaacucggagugcaucacccccaacggguccauccccaacgacaagcccuuccagaacgugaaccgcgucacguacggcgccugcccgcgguacgugaagcagaacacccugaagcucgccaccgggaugcgcaacgugcccgagaagcagacccggggcaucuucggggccaucgccggcuucaucgagaacggcugggaggggauggucgacggcugguacggguuccgccaccagaacagcgagggcacggggcaggccgccgaccugaaguccacccaggcggccaucgaccagaucaacggcaagcugaaccggcucaucgagaagaccaacgagaaguuccaccagaucgagaaggaguucucggagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagcggacccgcaagcagcugcgcgagaacgccgaggacauggggaacggcugcuucaagaucuaccacaagugcgacaacgcgugcaucggguccauccggaacggcaccuacgaccacgacguguacaaggacgaggcccucaacaaccgcuuccagaucaagggggucgugcucaagucgggcuacaaggacuggauccuguggaucuccuucgccaucagcugcuuccugcugugcgugguccugcucggcuucaucaugugggccugccagaaggggaacauccggugcaacaucugcaucuga

SEQ ID NO: 1226 - RNA, 1701 nt, Artificial Sequence
  derived and/or modified CDS sequence (AUadapt) from InfluenzaA__ABG37197__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaccaacgagggguucaacuggaacggcguggcccaggacgggaaguccuacgccugcaagcgcggcuccgucaagucguucuucucccggcugaacuggcuccacaagcuggaguacaaguaccccgcgcugaacgugaccaugcccaacaacgacaaguucgacaagcucuacaucuggggcgugcaccaccccucgaccgacuccgaccagacgagccuguacgugcaggccuccgggcgcgucaccgugucgaccaagcggagccagcagaccgugaucccgaacaucggcucccgccccuggguccgggggaucucgucccgcaucagcaucuacuggacgaucgugaagcccggcgacauccugcucaucaacuccaccgggaaccugaucgcgccccggggcuacuucaagauccgcaacggcaagucguccaucaugcggucggacgccccgaucgacaacugcaacuccgagugcaucacccccaacgggagcauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagucgacgcaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagcggacccgcaagcagcugcgcgagaacgccgaggacauggggaacggcugcuucaagaucuaccacaagugcgacaacgcgugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 1227 - RNA, 1701 nt, Artificial Sequence
  derived and/or modified CDS sequence (AUadapt) from InfluenzaA__ABG37208__HA
augaagaccaucaucgcccugucguacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucucgaacugcuaccccuacgacgugccggacuacgcgucccugcggagccucgucgccuccucgggcacgcuggaguucaucaacgagggguucaacuggaccggcgugacccaguccgggggcagcuacgccugcaagcgcggguccgugaacucguucuucucccggcugaacuggcucuacaagagcgaguccaaguaccccgcccugaacgucaccaugcccaacaacggcaaguucgacaagcuguacaucuggggcgugcaccaccccucgacggacaaggagcagaccaaccucuacgugcgcgcgagcgggcgggucaccguguccaccaagcgcucgcagcagacggugaucccgaacaucggcccccggcccuggguccgcgggcuguccagccggaucuccaucuacuggaccaucgugaagcccggcgacauccugcucaucaacucgaccggcaaccugaucgccccgcgcggguacuucaagauccggaccggcaaguccagcaucaugcgcuccgacgcccccaucgggacgugcucguccggcugcaucacccccaacgggagcauccccaacgacaagccguuccagaacgugaacaagaucaccuacggcgccugcccccgguacgucaagcagaacacccugaagcucgccacgggcaugcgcaacgugcccgagaagcagacccgggggaucuucggcgcgaucgccggguucaucgagaacggcugggaggggaugguggacggcugguacggcuuccgccaccagaacuccgaggggaccggccaggccgccgaccucaagucgacccaggccgcgaucgaccagaucaacgggaagcugaaccggcucaucgagaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgacaugaccgacuccgagaugaacaagcuguucgagaagacgcggaagcagcugcgcgagaacgccgaggacauggggaacggcugcuucaagaucuaccacaagugcgacaacgccugcaucggcucgauccgcaacgggaccuacgaccacgacgucuaccgggacgaggcgcugaacaaccgcuuccagaucaagggcguggagcucaaguccggguacaaggacuggauccuguggaucagcuucgccaucagcugcuuccugcucugcgucgugcugcugggcuucaucaugugggccugccagaagggcaacauccggugcaacaucugcaucuga

SEQ ID NO: 1228 - RNA, 1701 nt, Artificial Sequence
  derived and/or modified CDS sequence (AUadapt) from InfluenzaA__ABG37230__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcaccagagcaaguacaaguaccccgagcugaacgucaccaugcccaacaacggcaaguucgacaagcucuacaucuggggcgugcaccaccccuccaccgacagcgaccagacgucccuguacgcgcgcgccucggggcgggugaccgucagcaccaagcgcucccagcagaccgugaucccgaacaucggcuuccggcccugggugcgcgggcugucgucccggaucagcaucuacuggacgaucgucaagcccggcgacauccuccugaucaacuccaccgggaaccugaucgcgccccgcggcuacuucaagauccggaacggcaagucguccaucaugcgcagcgacgccccgaucgggaacugcuccucggagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggcuucaucgagaacgggugggagggcaugguggacgggugguacggcuuccggcaccagaacagcgaggggaccggccaggccgccgaccugaaguccacgcaggcggccaucgaccagaucaacggcaagcucaaccgccugaucgagaagaccaacgagaaguuccaccagaucgagaaggaguucucggagguggaggggcggauccaggaccuggagaaguacgucgaggacaccaagaucgaccucugguccuacaacgccggccugcugguggcccucgagaaccagcacaccaucgaccugacggacagcgagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggcgucgagcugaaguccggguacaaggacuggauccucuggaucuccuucgccaucagcugcuuccugcugugcgugguccuccugggcuucaucaugugggccugccagaaggggaacauccggugcaacaucugcaucuga

SEQ ID NO: 1229 - RNA, 1701 nt, Artificial Sequence
  derived and/or modified CDS sequence (AUadapt) from InfluenzaA__ABG37241__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucgucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacucgaacugcuacccguacgacgugcccgacuacgcgucccuccggagccuggucgccuccucgggcacgcuggaguucaccaacgagaacuucaacuggaccgggguggcccaggacggcaaguccuacgccugcaagcgcgggagcgugaacuccuucuucucgcggcucaacuggcugcacaagcuggaguacaaguaccccgcgcucaacgucaccaugcccaacaacggcaaguucgacaagcuguacaucuggggcgugcaccacccguccacggacagcgaccagaccucccuguacgugcgcgccucggggaaggucaccguguccaccaagcggagccagcagacggugauccccgacaucggcuaccgccccuggguccgggggcucucgucccgcaucagcaucuacuggaccaucgugaagcccggcgacauccugcugaucaacuccaccgggaaccucaucgccccgcggggcuacuucaagauccgcaacggcaagucguccaucaugcggagcgacgcccccaucgggaacugcuccucggagugcaucacccccaacggcuccauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacagcgaggggacgggccaggccgccgaccucaaguccacccaggcggccaucgaccagaucaacggcaagcugaaccggcuggucgagaagaccaacgagaaguuccaccagaucgagaaggaguucucggagguggaggggcgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagucgggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 1230 - RNA, 1701 nt, Artificial Sequence
  derived and/or modified CDS sequence (AUadapt) from InfluenzaA__ABG37252__HA
augaagaccaucaucgcccugucguacauccucugccugguguucgcccagaagcugaccggcaacgacaacuccacggcgacccucugccuggggcaccacgccguccccaacggcacccuggugaagaccaucacgaacgaccagaucgaggugaccaacgccaccgagcucguccagucguccccgaccgggcgcaucugcgacagcccccaccggauccuggacggcaagaacugcacgcugaucgacgcccuccugggggacccccacugcgacggcuuccagaacaaggagugggaccuguucguggagcgcuccaaggccuacucgaacugcuaccccuacgacgugccggacuacgcgucccuccggagccuggucgccuccucgggcacccuggaguucaccaacgagaacuucaacuggaccgggguggcccaggacggcaaguccuacgccugcaagcgcgggagcgugaacuccuucuucucgcggcucaacuggcugcacaagcuggaguacaaguaccccgcgcucaacgucacgaugcccaacaacggcaaguucgacaagcuguacaucuggggcgugcaccaccccuccaccgacagcgaccagaccucccuguacgugcgcgccucggggaaggucaccguguccacgaagcggagccagcagaccgugaucccggacaucggcuaccgccccuggguccgggggcucucgucccgcaucagcaucuacuggaccaucgugaagcccggcgacauccugcugaucaacuccaccgggaaccucaucgcgccccggggcuacuucaagauccgcaacggcaagucguccaucaugcggagcgacgccccgaucgggaacugcuccucggagugcaucacgcccaacggcuccauccccaacgacaagcccuuccagaacgugaaccgcaucaccuacggggccugcccgcgguacgucaagcagaacacccugaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccucaaguccacccaggcggccaucgaccagaucaacggcaagcugaaccggcuggucgagaagaccaacgagaaguuccaccagaucgagaaggaguucucggagguggaggggcgcauccaggaccucgagaaguacguggaggacacgaagaucgaccugugguccuacaacgccgagcugcucgucgcccuggagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagucgggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 1231 - RNA, 1701 nt, Artificial Sequence
  derived and/or modified CDS sequence (AUadapt) from InfluenzaA__ABG37263__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaaggagggguucaacuggaccggcguggcccaggacgggaaguccuacgccugcaagcgcggcuccgugaacucguucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccucgcuguacgugcaggccuccgggcgcgucaccgugagcaccaagcggucgcagcagacggugaucccgaacaucggcucccgccccuggguccgggggaucagcucccgcaucucgaucuacuggaccaucgugaagcccggcgacauccuccugaucaacuccaccgggaaccugaucgcgccccggggcuacuucaagauccgcaacggcaagagcuccaucaugcggucggacgccccgaucgggaacugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacacgugcaucggcucgauccggaacgggaccuacgaccacgacgucuaccgcgacgaggcgcugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 1232 - RNA, 1701 nt, Artificial Sequence
  derived and/or modified CDS sequence (AUadapt) from InfluenzaA__ABG37274__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggucgcuggucgccuccagcggcacgcuggaguucaccaacgagaacuucaacuggaccgggguggcccaggacggcaaguccuacgccugcaagcgcgggagcgugaacuccuucuucucgcggcucaacuggcugcacaagcuggaguacaaguaccccgcgcucaacgucaccaugcccaacaacggcaaguucgacaagcuguacaucuggggcgugcaccacccguccacggacagcgaccagaucucccuguacgugcgcgccucggggaaggucaccguguccaccaagcggagccagcagaccgugauccccgacaucggcuaccgccccuggguccgggggcucucgucccgcaucagcaucuacuggacgaucgugaagcccggcgacauccugcugaucuccagcaccgggaaccucaucgccccgcggggcuacuucaagauccgcaacggcaaguccucgaucaugcgguccgacgcccccaucgggaacugcagcuccgagugcaucacccccaacggcucgauccccaacgacaagccguuccagaacgugaaccgcaucaccuacggggccugcccccgguacgucaagcagaacacgcugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggucguacaacgccgagcugcucgucgcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 1233 - RNA, 1701 nt, Artificial Sequence
  derived and/or modified CDS sequence (AUadapt) from InfluenzaA__ABG37285__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggucgcuggucgccuccagcggcacgcuggaguucaccaacgagaacuucaacuggaccgggguggcccaggacggcaaguccuacgccugcaagcgcgggucggugaacuccuucuucagccggcucaacuggcugcacaagcuggacuacaaguaccccgcgcucaacgucaccaugcccaacaacggcaaguucgacaagcuguacaucuggggcgugcaccacccguccacggacucggaccagaccucccuguacgugcgcgccagcgggaaggucaccguguccaccaagcggucgcagcagacggugauccccgacaucggcuaccgccccuggguccgggggcucagcucccgcaucucgaucuacuggaccaucgugaagcccggcgacauccugcugaucaacuccaccgggaaccucaucgccccgcggggcuacuucaagauccgcaacggcaagagcuccaucaugcggucggacgcccccaucgggaacugcuccagcgagugcaucacccccaacggcuccauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacucggaggggacgggccaggccgccgaccucaaguccacccaggcggccaucgaccagaucaacggcaagcugaaccggcuggucgagaagaccaacgagaaguuccaccagaucgagaaggaguucagcgagguggaggggcgcauccaggaccucgagaaguacguggaggacaccaagaucgaccugugguccuacaacgccgagcugcucgucgcccuggagaaccagcacacgaucgaccugaccgacucggagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagagcggcuacaaggacuggauccuguggaucuccuucgccaucagcugcuuccugcucugcuucgugcugcugggguucaucaugugggccugccagaagggcaacauccgcugcaacaucugcaucuga

SEQ ID NO: 1234 - RNA, 1701 nt, Artificial Sequence
  derived and/or modified CDS sequence (AUadapt) from InfluenzaA__ABG37296__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaaggagggguucaacuggaccggcguggcccaggacgggaaguccuacgccugcaagcgcggcuccgugaacucguucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccucgcuguacgugcaggccuccgggcgcgucaccgugagcaccaagcggucgcagcagacggugaucccgaacaucggcucccgccccuggguccgggggaucagcucccgcaucucgaucuacuggaccaucgugaagcccggcgacauccuccugaucaacuccaccgggaaccugaucgcgccccggggcuacuucaagauccgcaacggcaagagcuccaucaugcggucggacgccccgaucgggaacugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 1235 - RNA, 1701 nt, Artificial Sequence; identical to SEQ ID NO: 1229
  derived and/or modified CDS sequence (AUadapt) from InfluenzaA__ABG37307__HA

SEQ ID NO: 1236 - RNA, 1701 nt, Artificial Sequence; identical to SEQ ID NO: 1234
  derived and/or modified CDS sequence (AUadapt) from InfluenzaA__ABG37318__HA

SEQ ID NO: 1237 - RNA, 1701 nt, Artificial Sequence
  derived and/or modified CDS sequence (AUadapt) from InfluenzaA__ABG37329__HA
augaagaccaucaucgcccugucguacauccucugccugguguucgcccagaagcugcccgagaacgacaacuccaccgcgacgcucugccugggccaccacgccgucccgaacgggacccuggugaagaccaucaccaacgaccagaucgaggugacgaacgccaccgagcucguccagucgucccccaccggccgcaucugcgacagcccccaccggauccuggacgggaagaacugcacccugaucgacgcccuccugggcgacccccacugcgacggguuccagaacaaggagugggaccuguucguggagcgcuccaaggccuacucgaacugcuacccguacgacgugcccgacuacgcgucccuccggagccuggucgccuccucgggcacgcuggaguucaccaacgagaacuucaacuggaccggcguggcccaggacgggaaguccuacgccugcaagcgcggcagcgugaacuccuucuucucgcggcucaacuggcugcacaagcuggaguacaaguaccccgcgcucaacgucaccaugcccaacaacgggaaguucgacaagcuguacaucuggggcgugcaccacccguccacggacagcgaccagaccucccuguacgugcgcgccucggggaaggucaccguguccaccaagcggagccagcagacggugauccccgacaucggcuaccgccccuggguccggggccucucgucccgcaucagcaucuacuggaccaucgugaagcccggggacauccugcugaucaacuccaccggcaaccucaucgccccgcggggguacuucaagauccgcaacggcaagucguccaucaugcggagcgacgcccccaucggcaacugcuccucggagugcaucacccccaacggguccauccccaacgacaagccguuccagaacgugaaccgcaucacguacggcgccugcccccgguacgucaagcagaacacccugaagcuggcgaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccucaaguccacccaggcggccaucgaccagaucaacggcaagcugaaccggcuggucgagaagaccaacgagaaguuccaccagaucgagaaggaguucucggagguggagggccgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagucgggcuacaaggacuggauccuguggaucuccuucgccaucagcugcuuccugcucugcguggugcugcugggcuucaucaugugggccugccagaaggggaacauccgcugcaacaucugcaucuga

SEQ ID NO: 1238 - RNA, 1701 nt, Artificial Sequence
  derived and/or modified CDS sequence (AUadapt) from InfluenzaA__ABG37340__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuuccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgagccuccggucccuggucgccucguccggcacgcuggaguucaccaacgagaacuucaacuggaccgggguggcccaggacggcaagagcuacuccugcaagcgcgggagcgugaacuccuucuucucgcggcucaacuggcugcacaagcuggaguacaaguaccccgcccucaacgucaccaugcccaacaacggcaaguucgacaagcuguacaucuggggcgugcaccacccguccacggacagcgaccagaccucccuguacgugcgcgcgucggggaaggucaccguguccaccaagcggagccagcagacggugauccccgacaucggcuaccgccccuggguccgggggcucucgucccgcaucagcaucuacuggaccaucgugaagcccggcgacauccugcugaucaacuccaccgggaaccucaucgccccgcggggcuacuucaagauccgcaacggcaagagcuccaucaugcggucggacgcccccaucgggaacugcuccagcgagugcaucacccccaacggcuccauccccaacgacaagccguuccagaacgugaaccgcaucacguacggggccugcccccgguacgucaagcagaacacccugaagcuggccaccggcaugcgcaacgugcccgagaagcagacccgggggaucuucggcgcgaucgccggcuucaucgagaacgggugggagggcaugguggacgggugguacggcuuccgccaccagaacucggaggggacgggccaggccgccgaccucaaguccacccaggccgcgaucgaccagaucaacggcaagcugaaccggcuggucgagaagaccaacgagaaguuccaccagaucgagaaggaguucagcgagguggaggggcgcauccaggaccucgagaaguacguggaggacaccaagaucgaccugugguccuacaacgccgagcugcucgucgcccuggagaaccagcacacgaucgaccugaccgacucggagaugaacaagcuguucgagcggacccgcaagcagcuccgcgagaacgccgaggacaugggcaacgggugcuucaagaucuaccacaagugcgacaacgccugcaucggcuccauccggaacgggaccuacgaccacgacguguaccgcgacgaggcgcugaacaaccgguuccagaucaagggcgucgagcucaagagcggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 1239 - RNA, 1701 nt, Artificial Sequence
  derived and/or modified CDS sequence (AUadapt) from InfluenzaA__ABG37351__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucgacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1240 - RNA, 1698 nt, Artificial Sequence
  derived and/or modified CDS sequence (AUadapt) from InfluenzaA__ABG37362__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1241 - RNA, 1698 nt, Artificial Sequence; identical to SEQ ID NO: 1045
  derived and/or modified CDS sequence (AUadapt) from InfluenzaA__ABG37384__HA

SEQ ID NO: 1242 - RNA, 1698 nt, Artificial Sequence; identical to SEQ ID NO: 1115
  derived and/or modified CDS sequence (AUadapt) from InfluenzaA__ABG37395__HA

SEQ ID NO: 1243 - RNA, 1701 nt, Artificial Sequence; identical to SEQ ID NO: 1022
  derived and/or modified CDS sequence (AUadapt) from InfluenzaA__ABG37406__HA

SEQ ID NO: 1244 - RNA, 1701 nt, Artificial Sequence
  derived and/or modified CDS sequence (AUadapt) from InfluenzaA__ABG37428__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaagucccaccagaucgagaaggaguucucggagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagucgggcuacaaggacugggugcuguggaucagcuucgccaucuccugcuuccugcugugcaucguccuccugggcuucaucaugugggccugccagaaggggaacauccggugcaacaucugcaucuga

SEQ ID NO: 1245 - RNA, 1701 nt, Artificial Sequence; identical to SEQ ID NO: 807
  derived and/or modified CDS sequence (AUadapt) from InfluenzaA__ABG37439__HA

SEQ ID NO: 1246 - RNA, 1701 nt, Artificial Sequence; identical to SEQ ID NO: 885
  derived and/or modified CDS sequence (AUadapt) from InfluenzaA__ABG37461__HA

SEQ ID NO: 1247 - RNA, 1701 nt, Artificial Sequence
  derived and/or modified CDS sequence (AUadapt) from InfluenzaA__ABG37472__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccaggugcuggacggcgagaacugcacccugaucgacgcccuccugggggacccccacugcgacggcuuccagaacaaggagugggaccuguucguggagcggagcaaggccuacuccaacugcuaccccuacgacgucccggacuacgugucgcuccgcucccugguggcgagcuccggcacgcuggaguucaacaacgagucguucaacuggaccggggucgcccagaacggcaccuccagcgccugcaagcggcgcuccgacaagucguucuucucccggcucaacuggcugcaccagcugaaguacaaguaccccgcccucaacgugaccaugcccaacaacgagaaguucgacaagcuguacaucuggggcgugcaccaccccgggacggacagcgaccagaucucccuguacgcgcaggccucggggcgcgucaccgugagcaccaagcggucccagcagaccgugaucccgaacaucggcucgcgccccuggguccggggcguguccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgucaaccgcaucaccuacggcccgugcccccgguacgugaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacgucuaccgggacgaggcgcugaacaaccgcuuccagaucaaggggguggagcugaaguccggcuacaaggacuggauccucuggaucucguucgccaucagcugcuuccugcugugcaucguccuccugggcuucaucaugugggccugccagaaggggaacauccggugcaacaucugcaucuga

SEQ ID NO: 1248 - RNA, 1701 nt, Artificial Sequence; identical to SEQ ID NO: 807
  derived and/or modified CDS sequence (AUadapt) from InfluenzaA__ABG37483__HA

SEQ ID NO: 1249 - RNA, 1701 nt, Artificial Sequence; identical to SEQ ID NO: 885
  derived and/or modified CDS sequence (AUadapt) from InfluenzaA__ABG37494__HA

SEQ ID NO: 1250 - RNA, 1701 nt, Artificial Sequence
  derived and/or modified CDS sequence (AUadapt) from InfluenzaA__ABG37505__HA
augaagaccaucaucgcccugucguacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgucucgcuccgcucccugguggcgagcuccggcacccuggaguucaacaacgagucguucaacuggacggggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggaccgacucggaccagaucucccuguacgcgcaggccagcgggcgcgugacggucucgaccaagcggucccagcagaccgugaucccgaacaucggcagccgccccugggugcggggcgucuccucgcgcaucuccaucuacuggaccaucgugaagcccggggacauccuccugaucaacagcacgggcaaccugaucgcgccccggggguacuucaagauccgcuccggcaagagcuccaucaugcggucggacgccccgaucgacaagugcaacuccgagugcaucacccccaacggcagcauccccaacgacaagcccuuccagaacgugaaccgcaucaccuacgggcucugcccgcgguacgucaagcagaacacccugaagcuggccacgggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagucgacccaggccgcgaucaaccagaucaacgggaagcugaaccggcugaucgagaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagcggacgaagaagcagcuccgcgagaacgccgaggacaugggcaacgggugcuucaagaucuaccacaagugcgacaacgccugcaucggcucgauccgcaacgggaccuacgaccacgacguguaccgggacgaggcgcugaacaaccgcuuccagaucaagggcgucgagcucaaguccggguacaaggacuggauccuguggaucagcuucgccaucagcugcuuccugcucugcaucgugcugcugggcuucaucaugugggccugccagaagggcaacauccggugcaacaucugcaucuga

SEQ ID NO: 1251 - RNA, 1701 nt, Artificial Sequence; identical to SEQ ID NO: 761
  derived and/or modified CDS sequence (AUadapt) from InfluenzaA__ABG37516__HA

SEQ ID NO: 1252 - RNA, 1701 nt, Artificial Sequence; identical to SEQ ID NO: 761
  derived and/or modified CDS sequence (AUadapt) from InfluenzaA__ABG37527__HA

SEQ ID NO: 1253 - RNA, 1701 nt, Artificial Sequence; identical to SEQ ID NO: 761
  derived and/or modified CDS sequence (AUadapt) from InfluenzaA__ABG37538__HA

SEQ ID NO: 1254 - RNA, 1701 nt, Artificial Sequence; identical to SEQ ID NO: 761
  derived and/or modified CDS sequence (AUadapt) from InfluenzaA__ABG37549__HA

SEQ ID NO: 1255 - RNA, 1701 nt, Artificial Sequence; identical to SEQ ID NO: 761
  derived and/or modified CDS sequence (AUadapt) from InfluenzaA__ABG37560__HA

SEQ ID NO: 1256 - RNA, 1701 nt, Artificial Sequence; identical to SEQ ID NO: 761
  derived and/or modified CDS sequence (AUadapt) from InfluenzaA__ABG37571__HA

SEQ ID NO: 1257 - RNA, 1701 nt, Artificial Sequence
  derived and/or modified CDS sequence (AUadapt) from InfluenzaA__ABG37582__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgcgucccugcggucgcucgucgccuccucggggacgcuggaguucaacaacgaguccuucgacuggaccggcgugacccagaacgggaccagcuccgccugcaagcgccggucgaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugucgacgaagcgcucgcagcagaccgugaucccgaacaucggcucccggccccgcguccgggacgugagcucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 1258 - RNA, 1701 nt, Artificial Sequence; identical to SEQ ID NO: 761
  derived and/or modified CDS sequence (AUadapt) from InfluenzaA__ABG37604__HA

SEQ ID NO: 1259 - RNA, 1701 nt, Artificial Sequence; identical to SEQ ID NO: 761
  derived and/or modified CDS sequence (AUadapt) from InfluenzaA__ABG37615__HA

SEQ ID NO: 1260 - RNA, 1698 nt, Artificial Sequence; identical to SEQ ID NO: 987
  derived and/or modified CDS sequence (AUadapt) from InfluenzaA__ABG47807__HA

SEQ ID NO: 1261 - RNA, 1698 nt, Artificial Sequence; identical to SEQ ID NO: 986
  derived and/or modified CDS sequence (AUadapt) from InfluenzaA__ABG47818__HA

SEQ ID NO: 1262 - RNA, 1701 nt, Artificial Sequence
  derived and/or modified CDS sequence (AUadapt) from InfluenzaA__ABG47829__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucaccaagcgccccaaggugcggaaccaggagggccgcaucaacuacuacuggacgcuccuggagcccggcgacaccaucaucuucgaggccaacgggaaccugaucgcccccugguacgccuucgcccucucgcggggcuucggguccggcaucaucaccagcaacgcguccaugggcgagugcgacgccaagugccagaccccgcagggggccaucaacagcucccugcccuuccagaacgugcaccccgucacgaucggcgagugccccaaguacgugcgcucgaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacgcagaacgccaucgacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacucgaacgucaagaaccuguacgagaaggugaagacccagcugaagaacaacgcgaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacucgacgguggccuccagccucguccugcuggugucccucggggccaucagcuucuggaugugcuccaacggcagccugcagugccgcaucugcaucuga

SEQ ID NO: 1263 - RNA, 1701 nt, Artificial Sequence
  derived and/or modified CDS sequence (AUadapt) from InfluenzaA__ABG47840__HA
augaaggugaagcugcucguccugcugugcgccuucaccgccaccuacgcggacacgaucugcaucggcuaccacgccaacaacucgaccgacaccguggacaccgugcucgagaagaacgucacggugacccacuccgugaaccugcuggaggacagccacaacgggaagcucugccgccugaagggcaccgcgccccugcagcucgggaacugcuccgucgccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugucguccgugagcuccuucgagcgcuucgagaucuucccgaaggagagcuccuggcccaaccacaccgugaccaagggggucaccgccagcugcucccacaacggcaagucguccuucuacaagaaccugcucuggcugacggagaagaacgggcuguaccccaaccucagcaaguccuacgugaacaacaaggagaaggaggugcugguccuguggggcgugcaccaccccagcaacaucggggaccagcgggccaucuaccacaccgagaacgccuacgugagcgucguguccagccacuacucccgccgguucaccccggagaucgcgaagcgccccaaggugcgggaccaggagggccgcaucaacuacuacuggacccuccuggagcccggcgacacgaucaucuucgaggccaacgggaaccugaucgcccccugguacgccuucgcccucucgcggggcuucggguccggcaucaucaccagcaacgcguccaugagcgagugcgacgccaagugccagaccccgcagggcgccaucaacuccagccugcccuuccagaacguccaccccgugaccaucggggagugccccaaguacgugcgcuccacgaagcugcggauggucaccggccuccgcaacaucccgucgauccagucccgggggcuguucggcgccaucgccggguucaucgagggcggcuggaccgggaugaucgacggcugguacggguaccaccaccagaacgagcagggcagcggguacgcggccgaccagaaguccacccagaacgccaucgacggcaucacgaacaaggugaacagcgugaucgagaagaugaacacccaguucaccgccgucggcaaggaguucaacaagcuggagcgccggauggagaaccucaacaagaagguggacgacggguuccuggacaucuggaccuacaacgccgagcugcucguccugcuggagaacgagcgcacgcucgacuuccacgacuccaacgugaagaaccuguacgagaaggugaagaaccagcugaagaacaacgcgaaggagaucggcaacgggugcuucgaguucuaccacaagugcaacaacgagugcauggagagcgucaagaacggcaccuacgacuaccccaaguacuccgaggagucgaagcucaaccgggagaagaucgacggggugaagcuggagagcaugggcguguaccagauccuggccaucuacuccaccgucgccagcucccucgugcugcuggugagccucggcgccaucuccuucuggaugugcagcaacgggucccugcagugccgcaucugcaucuga

SEQ ID NO: 1264 - RNA, 1701 nt, Artificial Sequence
  derived and/or modified CDS sequence (AUadapt) from InfluenzaA__ABG47851__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaacgagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagauccgcaacggcaagucguccaucaugcggagcgacgccccgaucgacaacugcaacuccgagugcaucacccccaacgggucgauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacaaccacgacgucuaccgcgacgaggcccugaacaaccgguuccagaucaaggggguggagcugaaguccggcuacaaggacuggauccucuggaucucguucgccaucuccugcuuccugcugugcgucgugcuccugggcuucaucaugugggccugccagaaggggaacauccgcugcagcaucugcaucuga

SEQ ID NO: 1265 - RNA, 1701 nt, Artificial Sequence
  derived and/or modified CDS sequence (AUadapt) from InfluenzaA__ABG47862__HA
augcgcaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcggaucugcaacagcccccaccgcauccuggacggcaagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccugaucgccucguccggcacgcuggaguucaccaacgagggguucaacuggaccggcgucgcccaggacgggaccagcuacgccugcaagcggggcuccgugaaguccuucuucucccgccucaacuggcugcacaagcuggaguacaaguaccccgcgcucaacgugacgaugcccaacaacgacaaguucgacaagcuguacaucuggggcguccaccaccccucgaccgacuccgaccagaccagccuguacgugcaggccuccgggcgggugaccgucucgacgaagcgcagccagcagaccgugaucccgaacaucggcucccggcccugggugcgcggggucucgucccggaucagcaucuacuggaccaucgugaagcccggcgacauccuccugaucaacuccaccgggaaccugaucgcgccccgcggcuacuucaagauccggucgggcaaguccagcaucaugcgcuccgacgccccgaucgggaacugcaacucggagugcaucacgcccaacggcuccauccccaacgacaagcccuuccagaacgugaaccggaucaccuacggggccugcccgcgcuacgucaagcagaacacccucaagcuggccaccggcaugcggaacgugcccgagaagcagacgcgcgggaucuucggcgccaucgccggcuucaucgagaacgggugggagggcaugguggacgggugguacggcuuccggcaccagaacagcgaggggaccggccaggccgccgaccugaaguccacccaggcggccaucaaccagaucaacggcaagcucaaccgccugaucgagaagaccaacgagaaguuccaccagaucgagaaggaguucucggaggucgaggggcggauccaggaccuggagaaguacguggaggacacgaagaucgaccucugguccuacaacgccgagcugcugguggcccucgagaaccagcacaccaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcucaagucgggcuacaaggacuggauccuguggaucuccuucgccaucagcugcuuccugcugugcgucgugcuccugggguucaucaugugggccugccagaagggcaacauccggugcaacaucugcaucuga

SEQ ID NO: 1266 - RNA, 1701 nt, Artificial Sequence; identical to SEQ ID NO: 1229
  derived and/or modified CDS sequence (AUadapt) from InfluenzaA__ABG47873__HA

SEQ ID NO: 1267 - RNA, 1701 nt, Artificial Sequence; identical to SEQ ID NO: 1234
  derived and/or modified CDS sequence (AUadapt) from InfluenzaA__ABG47895__HA

SEQ ID NO: 1268 - RNA, 1701 nt, Artificial Sequence; identical to SEQ ID NO: 1229
  derived and/or modified CDS sequence (AUadapt) from InfluenzaA__ABG47906__HA

SEQ ID NO: 1269 - RNA, 1701 nt, Artificial Sequence
  derived and/or modified CDS sequence (AUadapt) from InfluenzaA__ABG47917__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1270 - RNA, 1701 nt, Artificial Sequence; identical to SEQ ID NO: 1269
  derived and/or modified CDS sequence (AUadapt) from InfluenzaA__ABG47928__HA

SEQ ID NO: 1271 - RNA, 1701 nt, Artificial Sequence
  derived and/or modified CDS sequence (AUadapt) from InfluenzaA__ABG47939__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacucccccuaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggcgggucaccgugagcaccaagcgcagccagcagaccgugaucccgaacaucggcuuccggcccuggguccgcgggcucuccucgcggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1272 - RNA, 1701 nt, Artificial Sequence
  derived and/or modified CDS sequence (AUadapt) from InfluenzaA__ABG47950__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucgcugggcacgcucgaguucaucaacgaggacuucaacuggaccgggguggcccaggacggcaaguccuacagcugcaagcgcggguccgugaacucguucuucucccggcugaacuggcugcacaagcucgaguacaaguaccccgcccugaacgucaccaugcccaacaacggcaaguucgacaagcuguacaucuggggcgugcaccaccccagcaccgacuccgaccagacgagccucuacgcgcgcgccuccgggcgggugaccgucucgaccaagcgcagccagcagaccgugaucccgaacaucggcuuccggcccugggugcgcgggcuguccagccggaucuccaucuacuggacgaucgucaagcccggcgacauccugcucaucaacucgaccgggaaccugaucgcgccccgcggcuacuucaagauccggaccggcaaguccagcaucaugcgcuccgacgccccgaucgggaacugcucguccgagugcaucacccccaacggcaacauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggcuucaucgagaacgggugggagggcaugguggacgggugguacggcuuccggcaccagaacagcgaggggacgggccaggccgccgaccugaaguccacccaggcggccaucgaccagaucaacggcaagcugaaccgccucaucgagaagaccaacgagaaguuccaccagaucgagaaggaguucagcgagguggaggggcggauccaggaccuggagaaguacgucgaggacaccaagaucgaccugugguccuacaacgccggcuuccucguggcccuggagaaccagcacacgaucgaccugaccgacucggagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggcgucgagcucaagagcggguacaaggacuggauccuguggaucuccuucgccaucagcugcuuccugcucugcgugguccugcugggcuucaucaugugggccugccagaaggggaacauccggugcaacaucugcaucuga

SEQ ID NO: 1273 - RNA, 1701 nt, Artificial Sequence
  derived and/or modified CDS sequence (AUadapt) from InfluenzaA__ABG47961__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacuccugcaagcgcgggagcgugaacuccuucuucagccggcucaacuggcugcacaagcuggaguacaaguaccccgcccucaacgucaccaugcccaacaacggcaaguucgacaagcuguacaucuggggcgugcaccaccccuccaccgacucggaccagacgucccuguacgugcgcgcgagcgggggcgucaccgugucgaccaagcggucccagcagaccgugaucccgaacaucgggagccgccccuggguccggggccucuccucgcgcaucuccaucuacuggacgaucgugaagcccggggacauccugcugaucaacagcaccggcaaccucaucgcgccccggggcuacuucaagaugcgcaacgggaaguccagcaucaugcgguccgacgccccgaucggcaacugcucguccgagugcaucacccccaacgggagcauccccaacgacaagcccuuccagaacgugaaccgcaucaccuacggcgccugcccgcgguacgucaagcagaacacgcugaagcuggccaccgggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagucgacgcaggccgcgaucgaccagaucaacgggaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgccugcaucggcucgauccggaacggcaccuacgaccacgacgucuaccgcgacgaggcgcugaacaaccgguuccagaucaaggggguggagcucaaguccggcuacaaggacuggauccuguggaucagcuucgccaucagcugcuuccugcucugcgucgugcugcugggguucaucaugugggccugccagaagggcaacauccgcugcaacaucugcaucuga

SEQ ID NO: 1274 - RNA, 1701 nt, Artificial Sequence; identical to SEQ ID NO: 1269
  derived and/or modified CDS sequence (AUadapt) from InfluenzaA__ABG47972__HA

SEQ ID NO: 1275 - RNA, 1701 nt, Artificial Sequence; identical to SEQ ID NO: 1269
  derived and/or modified CDS sequence (AUadapt) from InfluenzaA__ABG47983__HA

SEQ ID NO: 1276 - RNA, 1701 nt, Artificial Sequence; identical to SEQ ID NO: 1269
  derived and/or modified CDS sequence (AUadapt) from InfluenzaA__ABG47994__HA

SEQ ID NO: 1277 - RNA, 1701 nt, Artificial Sequence
  derived and/or modified CDS sequence (AUadapt) from InfluenzaA__ABG48005__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucaaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1278 - RNA, 1701 nt, Artificial Sequence; identical to SEQ ID NO: 1269
  derived and/or modified CDS sequence (AUadapt) from InfluenzaA__ABG48016__HA

SEQ ID NO: 1279 - RNA, 1701 nt, Artificial Sequence; identical to SEQ ID NO: 1269
  derived and/or modified CDS sequence (AUadapt) from InfluenzaA__ABG48027__HA

SEQ ID NO: 1280 - RNA, 1698 nt, Artificial Sequence
  derived and/or modified CDS sequence (AUadapt) from InfluenzaA__ABG48049__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccucgugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcacccacuacucccgccgguucacccccgagaucgccaagcgccccaaggugcgggaccaggagggccgcaucaacuacuacuggacccuccuggagcccggggacacgaucaucuucgaggcgaacggcaaccugaucgccccgcgguacgccuucgcccucagccgcggguucggcuccggcaucaucaccagcaacgcccccauggacgagugcgacgcgaagugccagacgccccagggggccaucaacuccucgcugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacucggucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacaacgagugcauggaguccgugaagaacgggacguacgacuaccccaaguacagcgaggaguccaagcucaaccgcgagaagaucgacggcgugaagcuggagagcaugggcgucuaccagauccuggccaucuacuccaccguggccucgagccucgugcugcuggucucccucggggccaucagcuucuggaugugcuccaacggcagccugcagugccggaucugcaucuga

SEQ ID NO: 1281 - RNA, 1701 nt, Artificial Sequence; identical to SEQ ID NO: 895
  derived and/or modified CDS sequence (AUadapt) from InfluenzaA__ABG48060__HA

SEQ ID NO: 1282 - RNA, 1701 nt, Artificial Sequence; identical to SEQ ID NO: 895
  derived and/or modified CDS sequence (AUadapt) from InfluenzaA__ABG48071__HA

SEQ ID NO: 1283 - RNA, 1701 nt, Artificial Sequence
  derived and/or modified CDS sequence (AUadapt) from InfluenzaA__ABG48082__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcugcaccccgggacggacagcgaccagaucucccucuacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccugcugaucaacucgaccggcaaccucaucgcgccccggggguacuucaagauccgcuccggcaagagcuccaucaugcggucggacgccccgaucggcaagugcaacuccgagugcaucacccccaacgggagcauccccaacggcaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugauggacgggugguacggcuuccgccaccagaacuccgaggggaccggccaggccgccgaccucaagucgacgcaggcggccaucaaccagaucaacggcaagcugaaccggcugaucgagaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacguguaccgggacgaggcccugaacaaccgcuuccagaucaagggcgucgagcucaaguccggcuacaaggacuggauccuguggaucagcuucgccaucagcugcuuccugcucugcaucgugcugcugggguucaucaugugggccugccagaagggcaacauccggugcaacaucugcaucuga

SEQ ID NO: 1284 - RNA, 1701 nt, Artificial Sequence
  derived and/or modified CDS sequence (AUadapt) from InfluenzaA__ABG48104__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucucgcuccggucccugguggcgagcuccggcacgcuggaguucaacaacgagucguucaacuggaccgggguggcccagaacggcaccuccagcgccugcaagcgccgguccgacaagucguucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgggugaccgucagcaccaagcgcucccagcagaccgugaucccgaacaucggcucgcggcccugggugcgcggcgucuccagccggaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgcgagaacgccgaggacauggggaacggcugcuucaagaucuaccacaagugcgacaacgccugcaucgggagcauccggaacggcaccuacgaccacgacguguaccgcgacgaggcgcugaacaaccgguuccagaucaagggggucgagcugaaguccggcuacaaggacuggauccucuggaucucguucgccaucagcugcuuccugcugugcaucgugcuccugggcuucaucaugugggccugccagaaggggaacauccgcugcaacaucugcaucuga

SEQ ID NO: 1285 - RNA, 1701 nt, Artificial Sequence; identical to SEQ ID NO: 885
  derived and/or modified CDS sequence (AUadapt) from InfluenzaA__ABG48115__HA

SEQ ID NO: 1286 - RNA, 1701 nt, Artificial Sequence; identical to SEQ ID NO: 892
  derived and/or modified CDS sequence (AUadapt) from InfluenzaA__ABG48126__HA

SEQ ID NO: 1287 - RNA, 1701 nt, Artificial Sequence; identical to SEQ ID NO: 807
  derived and/or modified CDS sequence (AUadapt) from InfluenzaA__ABG48148__HA

SEQ ID NO: 1288 - RNA, 1701 nt, Artificial Sequence; identical to SEQ ID NO: 807
  derived and/or modified CDS sequence (AUadapt) from InfluenzaA__ABG48159__HA

SEQ ID NO: 1289 - RNA, 1701 nt, Artificial Sequence
  derived and/or modified CDS sequence (AUadapt) from InfluenzaA__ABG48170__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugaaguccgacgccccgaucggcaagugcaacuucgagugcaucacccccaacggguccauccccaacggcaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacucggaggggaccggccaggccgccgaccugaaguccacgcaggcggccaucaaccagaucaacggcaagcucaaccgccugaucgagaagaccaacgagaaguuccaccagaucgagaaggaguucagcgagguggaggggcggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgccgaggacaugggcaacgggugcuucaagaucuaccacaagugcgacaacgcgugcaucggcuccauccgcaacgggaccuacgaccacgacguguaccgcgacgaggcccugaacaaccgguuccagaucaagggcgucgagcucaagagcggcuacaaggacuggauccuguggaucuccuucgccaucagcugcuuccugcugugcaucgugcuccugggguucaucaugugggccugccagaagggcaacauccgcugcaacaucugcaucuga

SEQ ID NO: 1290 - RNA, 1701 nt, Artificial Sequence
  derived and/or modified CDS sequence (AUadapt) from InfluenzaA__ABG48181__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccuacgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccuccgggcgcgugaccgucagcaccaagcggucgcagcagaccgugaucccgaacaucggcucccgccccugggugcggggcgucagcucccgcaucucgaucuacuggacgaucgugaagcccggggacauccuccugaucaacuccaccggcaaccugaucgcgccccggggguacuucaagauccgcagcggcaaguccucgaucaugcgguccgacgccccgaucggcaagugcaacagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacucggagggcaccgggcaggccgccgaccugaaguccacgcaggcggccaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcugaaguccggcuacaaggacugggugcucuggaucuccuucgccaucagcugcuuccugcugugcaucguccuccugggcuucaucaugugggccugccagaaggggaacauccggugcaacaucugcaucuga

SEQ ID NO: 1291 - RNA, 1701 nt, Artificial Sequence; identical to SEQ ID NO: 807
  derived and/or modified CDS sequence (AUadapt) from InfluenzaA__ABG48192__HA

SEQ ID NO: 1292 - RNA, 1701 nt, Artificial Sequence
  derived and/or modified CDS sequence (AUadapt) from InfluenzaA__ABG48203__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacgugugcaucuga

SEQ ID NO: 1293 - RNA, 1701 nt, Artificial Sequence; identical to SEQ ID NO: 761
  derived and/or modified CDS sequence (AUadapt) from InfluenzaA__ABG48214__HA

SEQ ID NO: 1294 - RNA, 1701 nt, Artificial Sequence; identical to SEQ ID NO: 761
  derived and/or modified CDS sequence (AUadapt) from InfluenzaA__ABG48236__HA

SEQ ID NO: 1295 - RNA, 1701 nt, Artificial Sequence
  derived and/or modified CDS sequence (AUadapt) from InfluenzaA__ABG48247__HA
augaagaccaucaucgcccugucguacauccucugccugguguucgcccagaagcugcccggcaacgacaacaacaccgcgacgcucugccuggggcaccacgccgucccgaacggcaccaucgugaagaccaucaccaacgaccagaucgaggugacgaacgccaccgagcugguccaguccucguccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgcgucccugcggucgcucgucgccuccucggggacgcuggaguucaacaacgaguccuucgacuggaccggcgugacccagaacgggaccucguccgccugcaagcgccggagcaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 1296 - RNA, 1701 nt, Artificial Sequence
  derived and/or modified CDS sequence (AUadapt) from InfluenzaA__ABG48269__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucgucccccaccgggggcaucugcgacucgccccaccagauccucgacggggagaacugcacccugaucgacgcccugcucggcgacccccagugcgacggcuuccagaacaagaagugggaccuguucguggagcgcuccaaggcccacucgaacugcuacccguacgacgugcccgacuacgcgucccugcggagccucgucgccuccucggggacgcuggaguucaacaacgaguccuucaacuggaccggcgugacccagaacgggaccucguccgccugcaagcgccggucgaacaaguccuucuucagccgccugaacuggcucacgcaccugaaguucaaguaccccgcccugaacgugaccaugcccaacaacgagaaguucgacaagcucuacaucuggggcguccaccacccggggaccgacaacgaccagaucucccuguacgcgcaggccucgggccggaucaccguguccacgaagcgcucgcagcagaccgugauccccaacaucggcucgcggccccgcguccgggacgugcccucccgcaucagcaucuacuggaccaucgugaagccgggggacauccugcucaucaacuccaccggcaaccugaucgcgccccggggguacuucaagauccgcucgggcaaguccucgaucaugcgguccgacgcccccaucggcaagugcaacucggagugcaucacgcccaacggguccaucccgaacgacaagcccuuccagaacgucaaccgcaucaccuacggcgccugcccccgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 1297 - RNA, 1701 nt, Artificial Sequence
  derived and/or modified CDS sequence (AUadapt) from InfluenzaA__ABG48291__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcgggagcuacgccugcaagcgcggcuccgugaacagcuucuucucccggcucaacuggcugcacaagucggaguacaaguaccccgcgcugaacgucuccaugcccaacaacgggaaguucaacaagcucuacaucuggggcgugcaccaccccagcaccgacuccgaccagaccucgcuguacgugcgcgccagcggccgggucacgguguccaccaagcgcucgcagcagaccgugaccccgaacaucgggucccggcccuggguccgcggccugagcucccggaucagcaucuacuggacgaucgugaagcccggggacauccuccugaucaacuccaccggcaaccugaucgcgccccgcggcuacuucaagauccggaacggcaagucguccaucaugcgcagcgacgccccgaucgggaccugcuccuucgagugcaucacccccaacgggucgauccccaacgacaagcccuuccagaacgugaaccggaucacguacggcgccugcccgcgcuacgucaagcagaacacccucaagcuggccaccgggaugcggaacgugcccgagaagcagacccgcggcaucuucggcgccaucgccggguucaucgagaacggcugggaggggaugguggacggcugguacggguuccggcaccagaacuccgagggcacgggccaggccgccgaccugaaguccacccaggcggccaucgaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagacccgcaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgguuccagaucaagggcguggagcugaaguccggguacaaggacuggauccucuggaucagcuucgccaucagcugcuuccugcugugcgucgugcuccugggcuucaucaugugggccugccagaaggggaacauccgcugcaacaucugcaucuga

SEQ ID NO: 1298 - RNA, 1701 nt, Artificial Sequence
  derived and/or modified CDS sequence (AUadapt) from InfluenzaA__ABG48335__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 1299 - RNA, 1701 nt, Artificial Sequence
  derived and/or modified CDS sequence (AUadapt) from InfluenzaA__ABG48346__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcaacaaggccuacuccaacugcuaccccuacgacgugccggacuacgcgucccuccggucgcuggucgccuccagcggcacgcuggaguucaucaacgaggacuucaacuggaccgggguggcccaggacggcaaguccuacgccugcaagcgcgggucggugaacuccuucuucagccggcucaacuggcugcacaagcuggaguacaaguaccccgcgcucaacgucaccaugcccaacaacggcaaguucgacaagcuguacaucuggggcgugcaccaccccuccaccgacucggaccagacgucccuguacgugcgcgccagcgggcgggucaccguguccaccaagcgcucgcagcagaccgugaucccgaacaucggcagccggcccuggguccgcgggcucuccucgcggaucuccaucuacuggacgaucgugaagcccggcgacauccugcugaucaacagcaccgggaaccucaucgcgccccgcggcuacuucaagauccggaacggcaaguccucgaucaugcgcuccgacgccccgaucgggaacugcagcuccgagugcaucacccccaacggcucgauccccaacgaccggcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggucguacaacgccgagcugcucguggcccuggagaaccagcacaccaucgaccugacggacuccgagaugaacaagcuguucgagcgcacccggaagcagcuccgcgagaacgccgaggacaugggcaacgggugcuucaagaucuaccacaagugcgacaacgcgugcaucggcagcauccggaacgggaccuacgaccacgacgucuaccgcgacgaggcccugaacaaccgguuccagaucaagggcguggagcucaaguccggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 1300 - RNA, 1701 nt, Artificial Sequence; identical to SEQ ID NO: 1298
  derived and/or modified CDS sequence (AUadapt) from InfluenzaA__ABG48357__HA

SEQ ID NO: 1301 - RNA, 1701 nt, Artificial Sequence
  derived and/or modified CDS sequence (AUadapt) from InfluenzaA__ABG48368__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacucggagaugaacaagcuguucgagcgcacccgcaagcagcuccgggagaacgccgaggacaugggcaacgggugcuucaaggucuaccacaagugcgacaacgcgugcaucgaguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggugcugcugggcuucaucaugugggccugccagaaggggaacauccggugcaacaucugcaucuga

SEQ ID NO: 1302 - RNA, 1701 nt, Artificial Sequence; identical to SEQ ID NO: 1152
  derived and/or modified CDS sequence (AUadapt) from InfluenzaA__ABG67135__HA

SEQ ID NO: 1303 - RNA, 1701 nt, Artificial Sequence; identical to SEQ ID NO: 1028
  derived and/or modified CDS sequence (AUadapt) from InfluenzaA__ABG67146__HA

SEQ ID NO: 1304 - RNA, 1701 nt, Artificial Sequence
  derived and/or modified CDS sequence (AUadapt) from InfluenzaA__ABG67157__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcaacucgccccaccggaucaucgacggcaagaacugcacccugaucgacgcccugcucggggacccccacugcgacggcuuccagaacaaggagugggaccuguucguggagcgcuccaaggccuacagcaacugcuacccguacgacgugcccgacuacgcgucccugcggucgcucgucgccuccagcggcacgcuggaguucaucaacgagaacuucaacuggaccgggguggcccaggacggcaaguccuacgccugcaagcgcgggucggugaacuccuucuucagccggcugaacuggcuccacaagcuggaguacaaguaccccgcgcugaacgucaccaugcccaacaacggcaaguucgacaagcucuacaucuggggcgugcaccacccguccaccgacucggaccagacgucccuguacgugcgcgccagcgggcgggucaccguguccaccaagcgcucgcagcagaccgugauccccgacaucggcuaccggcccuggguccgcgggcugagcucccggaucucgaucuacuggacgaucgugaagcccggcgacauccuccugaucaacuccaccgggaaccugaucgccccgcgcggcuacuucaagcuccggaacggcaagagcuccaucaugcgcucggacgcccccaucgggaacugcuccagcgagugcaucacccccaacggcuccauccccaacgacaagccguuccagaacgugaaccggaucaccuacggggccugcccccgcuacaucaagcagaacacgcugaagcuggcgaccggcaugcggaacguccccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugguggagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacucggagaugaacaagcuguucgagcgcaccaagaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgguuccagaucaagggcguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 1305 - RNA, 1701 nt, Artificial Sequence; identical to SEQ ID NO: 1229
  derived and/or modified CDS sequence (AUadapt) from InfluenzaA__ABG67168__HA

SEQ ID NO: 1306 - RNA, 1701 nt, Artificial Sequence; identical to SEQ ID NO: 1229
  derived and/or modified CDS sequence (AUadapt) from InfluenzaA__ABG67179__HA

SEQ ID NO: 1307 - RNA, 1701 nt, Artificial Sequence
  derived and/or modified CDS sequence (AUadapt) from InfluenzaA__ABG67190__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuuccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgagccuccggucccuggucgccucguccggcacgcuggaguucaccaacgagaacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccacccgagcacggacuccgaccagaccucgcuguacgugcgcgccuccgggaaggucaccgugagcaccaagcggucccagcagacggugauccccgacaucggcuaccgccccuggguccgggggcucagcucgcgcaucuccaucuacuggaccaucgugaagcccggcgacauccugcugaucaacagcaccgggaaccucaucgccccgcggggcuacuucaagauccgcaacggcaaguccucgaucaugcgguccgacgcccccaucgggaacugcagcuccgagugcaucacccccaacggcucgauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggucguacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 1308 - RNA, 1701 nt, Artificial Sequence
  derived and/or modified CDS sequence (AUadapt) from InfluenzaA__ABG67212__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguaccgcuaccccgcgcucaacgucaccaugcccaacaacggcaaguucgacaagcuguacaucuggggcgugcaccaccccagcaccgacuccgaccagacgagccuguacgugcgggccuccgggcgcgucaccgugucgaccaagcggagccagcagaccgugaucccgaacaucggcuuccgccccuggguccgggggcucuccagccgcaucuccaucuacuggacgaucgugaagcccggcgacauccugcugaucaacucgaccgggaaccucaucgcgccccggggcuacuucaagauccgcaacggcaaguccagcaucaugcgguccgacgccccgaucgggaacugcucguccgagugcaucacccccaacggcagcauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggucguacaacgccggccugcucguggcccuggagaaccagcacaccaucgaccugacggacuccgagaugaacaagcuguucgagcgcacccggaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcucaaguccggguacaaggacuggauccuguggaucagcuucgccaucuccugcuuccugcucugcgucgugcugcugggcuucaucaugugggccugccagaaggggaacauccgcugcaacaucugcaucuga

SEQ ID NO: 1309 - RNA, 1701 nt, Artificial Sequence; identical to SEQ ID NO: 1269
  derived and/or modified CDS sequence (AUadapt) from InfluenzaA__ABG67223__HA

SEQ ID NO: 1310 - RNA, 1701 nt, Artificial Sequence
  derived and/or modified CDS sequence (AUadapt) from InfluenzaA__ABG67234__HA
augaagaccaucaucgcccugucguacauccucugccugguguucgcccagaagcugcccggcgacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucguggagcccggcgacauccugcugaucaacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1311 - RNA, 1701 nt, Artificial Sequence
  derived and/or modified CDS sequence (AUadapt) from InfluenzaA__ABG67245__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucgacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1312 - RNA, 1698 nt, Artificial Sequence; identical to SEQ ID NO: 987
  derived and/or modified CDS sequence (AUadapt) from InfluenzaA__ABG67477__HA

SEQ ID NO: 1313 - RNA, 1698 nt, Artificial Sequence; identical to SEQ ID NO: 1045
  derived and/or modified CDS sequence (AUadapt) from InfluenzaA__ABG67491__HA

SEQ ID NO: 1314 - RNA, 1701 nt, Artificial Sequence
  derived and/or modified CDS sequence (AUadapt) from InfluenzaA__ABG67502__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugagcgacuacgucucccuccgcucgcugguggcguccagcggcacgcuggaguucaacaacgaguccuucaacuggaccgggguggcccagaacggcaccucguccgccugcaagcggcgcagcgacaaguccuucuucucgcggcucaacuggcugcaccagcugaaguacaaguacccggcccucaacgucaccaugcccaacaacgagaaguucgacaagcuguacaucuggggcgugcaccaccccgggacggacuccgaccagaucagccuguacgcgcaggccucggggcgcgugaccgucuccaccaagcggagccagcagaccgugauccccaacaucggcucccgcccgugggugcggggcaucucgucccgcaucagcaucuacuggacgaucgucaagcccggggacauccuccugaucaacuccaccggcaaccugaucgcgccccggggguacuucaagauccgcucgggcaaguccagcaucaugcgguccgacgcccccaucggcaagugcaacucggagugcaucaccccgaacggguccauccccaacgacaagcccuuccagaacgugaaccgcaucaccuacggccccugcccgcgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggccgcgaucaaccagaucaacggcaagcucaaccggcugaucgagaagaccaacgagaaguuccaccagaucgagaaggaguucucggagguggagggccgcauccaggaccuggagaaguacguggaggacaccaagaucgaccucugguccuacaacgccgagcugcuggucgcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacguguaccgggacgaggcgcugaacaaccgcuuccagaucaaggggguggagcugaaguccggcuacaaggacuggauccucuggaucagcuucgccaucuccugcuuccugcugugcaucguccuccugggcuucaucaugugggccugccagaaggggaacauccggugcaacaucugcaucuga

SEQ ID NO: 1315 - RNA, 1701 nt, Artificial Sequence
  derived and/or modified CDS sequence (AUadapt) from InfluenzaA__ABG67524__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucucgcuccggucccugguggcgagcuccggcacgcuggaguucaacaacgagucguucaacuggaccgggguggcccagaacggcaccuccagcgccugcaagcgccgguccgacaagucguucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgggugaccgucagcaccaagcgcucccagcagaccgugaucccgaacaucggcucgcggcccugggugcgcggcgucuccagccggaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcggugaaccagaucaacggcaagcucaaccgccugaucgagaagaccaacgagaaguuccaccagaucgagaaggaguucuccgaggucgagggccggauccaggaccuggagaaguacguggaggacaccaagaucgaccucuggucguacaacgccgagcugcugguggcccucgagaaccagcacaccaucgaccugacggacuccgagaugaacaagcuguucgagcgcaccaagaagcagcuccgcgagaacgccgaggacauggggaacggcugcuucaagaucuaccacaagugcgacaacgccugcaucgggagcauccggaacggcaccuacgaccacgacgucuaccgcgacgaggcgcugaacaaccgguuccagaucaaggggguggagcugaaguccggcuacaaggacuggauccucuggaucucguucgccaucagcugcuuccugcugugcaucguccuccugggcuucaucaugugggccugccagaaggggaacauccgcugcaacaucugcaucuga

SEQ ID NO: 1316 - RNA, 1701 nt, Artificial Sequence; identical to SEQ ID NO: 807
  derived and/or modified CDS sequence (AUadapt) from InfluenzaA__ABG67535__HA

SEQ ID NO: 1317 - RNA, 1701 nt, Artificial Sequence; identical to SEQ ID NO: 761
  derived and/or modified CDS sequence (AUadapt) from InfluenzaA__ABG67546__HA

SEQ ID NO: 1318 - RNA, 1701 nt, Artificial Sequence
  derived and/or modified CDS sequence (AUadapt) from InfluenzaA__ABG67557__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcgaccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 1319 - RNA, 1701 nt, Artificial Sequence; identical to SEQ ID NO: 761
  derived and/or modified CDS sequence (AUadapt) from InfluenzaA__ABG67568__HA

SEQ ID NO: 1320 - RNA, 1701 nt, Artificial Sequence; identical to SEQ ID NO: 761
  derived and/or modified CDS sequence (AUadapt) from InfluenzaA__ABG67579__HA

SEQ ID NO: 1321 - RNA, 1701 nt, Artificial Sequence; identical to SEQ ID NO: 761
  derived and/or modified CDS sequence (AUadapt) from InfluenzaA__ABG67590__HA

SEQ ID NO: 1322 - RNA, 1701 nt, Artificial Sequence; identical to SEQ ID NO: 761
  derived and/or modified CDS sequence (AUadapt) from InfluenzaA__ABG67601__HA

SEQ ID NO: 1323 - RNA, 1701 nt, Artificial Sequence; identical to SEQ ID NO: 761
  derived and/or modified CDS sequence (AUadapt) from InfluenzaA__ABG67612__HA

SEQ ID NO: 1324 - RNA, 1701 nt, Artificial Sequence; identical to SEQ ID NO: 761
  derived and/or modified CDS sequence (AUadapt) from InfluenzaA__ABG67623__HA

SEQ ID NO: 1325 - RNA, 1701 nt, Artificial Sequence
  derived and/or modified CDS sequence (AUadapt) from InfluenzaA__ABG67634__HA
augaagaccaucaucgcccugucguacauccucugccugguguucgcccagaagcugcccggcaacgacaacaacaccgcgacgcucugccuggggcaccacgccgucccgaacggcaccaucgugaagaccaucaccaacgaccagaucgaggugacgaacgccaccgagcugguccaguccucguccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgcgucccugcggucgcucgucgccuccucggggacgcuggaguucaacaacgaguccuucgacuggaccggcgugacccagaacgggaccucguccgccugcaagcgccggagcaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucgaagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 1326 - RNA, 1701 nt, Artificial Sequence; identical to SEQ ID NO: 761
  derived and/or modified CDS sequence (AUadapt) from InfluenzaA__ABG67645__HA

SEQ ID NO: 1327 - RNA, 1701 nt, Artificial Sequence
  derived and/or modified CDS sequence (AUadapt) from InfluenzaA__ABG67656__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacugggccggcgugacccagaacgggaccuccucggccugcaagcgccgguccaacaagagcuucuucucccgccugaacuggcucacccaccugaaguacaaguaccccgcgcugaacgugacgaugcccaacaacgagaaguucgacaagcucuacaucuggggcguccaccaccccgggaccgacucggaccagaucucccuguacgcccaggccucgggccggaucaccgugucgaccaagcgcucccagcagacggugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacccccaacgggucgauccccaacgacaagcccuuccagaacgucaaccgcaucacguacggcgccugcccgcgguacgugaagcagaacacccugaagcucgccaccgggaugcgcaacgugcccgagaagcagacccggggcaucuucggggccaucgccggcuucaucgagaacggcugggaggggauggucgacggcugguacggguuccgccaccagaacuccgagggcacggggcaggccgcggaccugaaguccacccaggccgccaucaaccagaucaacggcaagcugaaccggcucaucggcaagaccaacgagaaguuccaccagaucgagaaggaguucuccgagaucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgcggaggacaugggcaacgggugcuucaagaucuaccacaagugcgacaacgccugcaucggcucgauccgcaacgggaccuacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggcgugccagaagggcaacauccggugcaacaucugcaucuga

SEQ ID NO: 1328 - RNA, 1701 nt, Artificial Sequence
  derived and/or modified CDS sequence (AUadapt) from InfluenzaA__ABG67667__HA
augaagaccaucaucgcccugucguacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgucgcugcggucccucgucgccagcuccggcacgcuggaguucaccaacgagggguucaacuggaucggcguggcccaggacgggaaguccuacgccugcaagcgcggcuccgugaacucguucuucucccggcugaacuggcuccacaagcuggaguacaaguaccccgcgcugaacgucaccaugcccaacaacgacaaguucgacaagcucuacaucuggggcgugcaccaccccagcaccgacuccgaccagacgucgcuguacgugcaggccuccgggcgcgucaccgugagcaccaagcggucgcagcagaccgugaucccgaacaucggcucccgccccuggguccgggggaucagcucccgcaucucgaucuacuggacgaucgugaagcccggcgacauccugcucaucaacuccaccgggaaccugaucgcgccccggggcuacuucaagauccgcaacggcaagagcuccaucaugcggucggacgccccgaucgacaacugcaacuccgagugcaucacccccaacgggagcauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugaucgacggcugguacggguuccgccaccagaacuccgagggcaccgggcaggccgccgaccucaagucgacgcaggcggccaucgaccagaucaacggcaagcugaaccggcugaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggacccgcaagcagcugcgcgagaacgccgaggacauggggaacggcugcuucaagaucuaccacaagugcgacaacgcgugcaucgggucgauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcgugguccugcucggcuucaucaugugggccugccagaaggggaacauccgcugcaacaucugcaucuga

SEQ ID NO: 1329 - RNA, 1701 nt, Artificial Sequence
  derived and/or modified CDS sequence (AUadapt) from InfluenzaA__ABG79941__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccccggggcgggugaccgugucgaccaagcgcucccagcagaccgucauccccaacaucggcagccggcccugggugcgcggcguguccucgcggaucuccaucuacuggacgaucgucaagcccggggacauccuccugaucaacugcaccggcaaccugaucgccccgcgcggguacuucaagauccggagcggcaaguccucgaucaugcgcuccgacgccagcaucggcaagugcaacuccgagugcaucacccccaacgggucgauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggucgauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcuccaucugcaucuga

SEQ ID NO: 1330 - RNA, 1701 nt, Artificial Sequence; identical to SEQ ID NO: 1166
  derived and/or modified CDS sequence (AUadapt) from InfluenzaA__ABG79952__HA

SEQ ID NO: 1331 - RNA, 1701 nt, Artificial Sequence; identical to SEQ ID NO: 1229
  derived and/or modified CDS sequence (AUadapt) from InfluenzaA__ABG79974__HA

SEQ ID NO: 1332 - RNA, 1701 nt, Artificial Sequence; identical to SEQ ID NO: 1229
  derived and/or modified CDS sequence (AUadapt) from InfluenzaA__ABG79985__HA

SEQ ID NO: 1333 - RNA, 1701 nt, Artificial Sequence
  derived and/or modified CDS sequence (AUadapt) from InfluenzaA__ABG79996__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggucgcuggucgccuccagcggcacgcuggaguucaccaacgagaacuucaacuggaccgggguggcccaggacggcaaguccuacucgugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccacccgucgacggacuccgaccagaccagccuguacgugcgcgcguccgggaaggucaccgugucgaccaagcggagccagcagacggugauccccgacaucggcuaccgccccuggguccgggggcucuccucgcgcaucuccaucuacuggaccaucgugaagcccggcgacauccugcugaucaacagcaccgggaaccucaucgccccgcggggcuacuucaagauccgcaacggcaaguccucgaucaugcgguccgacgcccccaucgggaacugcagcuccgagugcaucacccccaacggcucgauccccaacgacaagccguuccagaacgugaaccgcaucacguacggggccugcccccgguacgucaagcagaacacccugaagcuggccaccggcaugcgcaacgugcccgagaagcagacccgggggaucuucggcgcgaucgccggcuucaucgagaacgggugggagggcaugguggacgggugguacggcuuccgccaccagaacuccgaggggacgggccaggccgccgaccucaagagcacccaggccgcgaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggucguacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgccugcaucggcagcauccggaacgggaccuacgaccacgacguguaccgcgacgaggcgcugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 1334 - RNA, 1701 nt, Artificial Sequence; identical to SEQ ID NO: 1229
  derived and/or modified CDS sequence (AUadapt) from InfluenzaA__ABG80007__HA

SEQ ID NO: 1335 - RNA, 1701 nt, Artificial Sequence; identical to SEQ ID NO: 1229
  derived and/or modified CDS sequence (AUadapt) from InfluenzaA__ABG80018__HA

SEQ ID NO: 1336 - RNA, 1701 nt, Artificial Sequence; identical to SEQ ID NO: 1234
  derived and/or modified CDS sequence (AUadapt) from InfluenzaA__ABG80029__HA

SEQ ID NO: 1337 - RNA, 1701 nt, Artificial Sequence; identical to SEQ ID NO: 1234
  derived and/or modified CDS sequence (AUadapt) from InfluenzaA__ABG80040__HA

SEQ ID NO: 1338 - RNA, 1701 nt, Artificial Sequence; identical to SEQ ID NO: 1229
  derived and/or modified CDS sequence (AUadapt) from InfluenzaA__ABG80051__HA

SEQ ID NO: 1339 - RNA, 1701 nt, Artificial Sequence
  derived and/or modified CDS sequence (AUadapt) from InfluenzaA__ABG80062__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaaggagggguucaacuggaccggcguggcccaggacgggaaguccuacgccugcaagcgcggcuccgugaacucguucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagauccgcaacggcaagucguccaucaugcggucggacgccccgaucgggaacugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacgucuaccgcgacgaggcccugaacaaccgguuccagaucaagggcguggagcugaagacgggcuacaaggacuggauccucuggaucuccuucgccaucagcugcuuccugcugugcgucgugcuccugggguucaucaugugggccugccagaagggcaacauccgcugcaacaucugcaucuga

SEQ ID NO: 1340 - RNA, 1701 nt, Artificial Sequence
  derived and/or modified CDS sequence (AUadapt) from InfluenzaA__ABG80073__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggaccccaacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccucgacggacuccgaccagaccagccuguacgugcgcgccuccggccgggucaccgugucgaccaagcgcucgcagcagacggugaccccgaacaucgggucccggcccuggguccgcggccucagcucccggaucucgaucuacuggaccaucgugaagcccggggacauccugcugaucaacuccaccggcaaccucaucgcgccccgcggcuacuucaagauccggaacgggaaguccuccaucaugcgcagcgacgccccgaucggcacgugcuccucggagugcaucacccccaacggguccauccccaacgacaagcccuuccagaacgugaaccggaucaccuacggcgccugcccgcgcuacgucaagcagaacacccugaagcuggccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccucaaguccacccaggcggccaucgaccagaucaacgggaagcugaaccgccugaucgagaagacgaacgagaaguuccaccagaucgagaaggaguucucggaggucgagggccggauccaggaccucgagaaguacguggaggacaccaagaucgaccugugguccuacaacgccgagcugcucguggcccuggagaaccagcacaccaucgaccugaccgacagcgagaugaacaagcuguucgagaagacgcgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 1341 - RNA, 1701 nt, Artificial Sequence
  derived and/or modified CDS sequence (AUadapt) from InfluenzaA__ABG80084__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagcggcaucuccaucuacuggacgaucgugaagcccggggacauccugcugaucaacucgaccggcaaccucaucgcgccccggggcuacuucaagauccgcaacgggaaguccagcaucaugcgguccgacgccccgaucggcaacugcucguccgagugcaucacccccaacgggagcauccccaacgacaagcccuuccagaacgugaaccgcaucaccuacggcgccugcccgcgguacgucaagcagaacacgcugaagcuggccaccgggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagagcacgcaggcggccaucgaccagaucaacgggaagcugaaccggcugaucgagaagaccaacgagaaguuccaccagaucgagaaggaguucuccgaggucgagggccgcauccaggaccucgagaaguacguggaggacaccaagaucgaccuguggucguacaacgccgggcugcucguggcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgcgugcaucggcagcauccggaacggcaccuacgaccacgacaucuaccgcgacgaggcccugaacaaccgguuccagaucaagggggucgagcucaaguccggcuacaaggacuggauccuguggaucagcuucgccaucuccugcuuccugcucugcgugguccugcugggguucaucaugugggccugccagaagggcaacauccgcugcaacaucugcaucuga

SEQ ID NO: 1342 - RNA, 1701 nt, Artificial Sequence
  derived and/or modified CDS sequence (AUadapt) from InfluenzaA__ABG80095__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaagguggacaagcuguacaucuggggcgugcaccaccccagcaccgacuccgaccagacgucgcuguacguccgcgccuccgggcgggugaccgugagcaccaagcgcucgcagcagaccgucaucccgaacaucggcuuccggcccugggugcgcgggcucuccagccggaucuccaucuacuggacgaucgugaagcccggcgacauccugcugaucaacagcaccgggaaccucaucgcgccccgcggcuacuucaagauccggaacggcaaguccucgaucaugcgcuccgacgccccgaucgggaacugcagcuccgagugcaucacccccaacggcucgauccccaacgacaagcccuuccagaacgucaaccggaucaccuacggggccugcccgcgcuacgugaagcagaacacgcugaagcuggccaccggcaugcggaacgugcccgagaagcagacccgcgggaucuucggcgccaucgccggcuucaucgagaacgggugggagggcauggucgacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgagguggaggggcggauccaggaccucgagaaguacguggaggacaccaagaucgaccuguggucguacaacgccggccugcucgucgcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucuccugcuuccugcucugcguggugcugcugggcuucaucaugugggccugccagaaggggaacauccggugcaacaucugcaucuga

SEQ ID NO: 1343 - RNA, 1701 nt, Artificial Sequence; identical to SEQ ID NO: 1269
  derived and/or modified CDS sequence (AUadapt) from InfluenzaA__ABG80106__HA

SEQ ID NO: 1344 - RNA, 1701 nt, Artificial Sequence
  derived and/or modified CDS sequence (AUadapt) from InfluenzaA__ABG80117__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacucgccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggcgggucaccgugagcaccaagcgcagccagcagaccgugaucccgaacaucggcuuccggcccuggguccgcgggcucuccucgcggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgugaagcagacccgcgggaucuucggcgccaucgccggcuucaucgagaacgggugggagggcauggucgacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgagguggaggggcggauccaggaccucgagaaguacguggaggacaccaagaucgaccuguggucguacaacgccggccugcucgucgcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucuccugcuuccugcucugcguggugcugcugggcuucaucaugugggccugccagaaggggaacauccggugcaacaucugcaucuga

SEQ ID NO: 1345 - RNA, 1701 nt, Artificial Sequence
  derived and/or modified CDS sequence (AUadapt) from InfluenzaA__ABG80128__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccgcaucgaggugacgaacgccaccgagcucguccagagcuccucgaccgggcggaucugcgacagcccccaccgcauccuggacggcaagaacugcacccugaucgacgcccuccugggggacccccacugcgacggcuuccagaacaaggagugggaccuguucguggagcgguccaaggccuacuccaacugcuaccccuacgacgugccggacuacgcgagccuccgcucccuggucgccucguccggcacgcuggaguucaucaacgaggacuucaacuggaccgggguggcccaggacggcaagagcuacgccugcaagcggggguccgugaacucguucuucucccgccucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgggccuccgggcgcgucaccgugucgaccaagcggagccagcagaccgugaucccgaacaucggcuuccgccccuggguccgggggcucuccagccgcaucuccaucuacuggacgaucgugaagcccggcgacauccugcugaucaacucgaccgggaaccucaucgcgccccggggcuacuucaagauccgcaacggcaaguccagcaucaugcgguccgacgccccgaucgggaacugcucguccgagugcaucacccccaacggcagcauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggucguacaacgccggccugcucguggcccuggagaaccagcacaccaucgaccugacggacuccgagaugaacaagcuguucgagcgcacccggaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcucaaguccggguacaaggacuggauccuguggaucagcuucgccaucuccugcuuccugcucugcgucgugcugcugggcuucaucaugugggccugccagaaggggaacauccgcugcaacaucugcaucuga

SEQ ID NO: 1346 - RNA, 1701 nt, Artificial Sequence
  derived and/or modified CDS sequence (AUadapt) from InfluenzaA__ABG80139__HA
augaagaccaucaucgcccugucguacauccucugccugguguucgcccagaagcugcccggcaacgacaacuccaccgcgacccucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagauccggaacggcaaguccagcaucaugcgcuccgacgccccgaucgggaacugcucguacgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccggccugcucguggcccuggagaaccagcacaccaucgaccugacggacucggagaugaacaagcuguucgagcgcacccgcaagcagcuccgggagaacgccgaggacauggggaacggcugcuucaagaucuaccacaagugcgacaacacgugcaucggguccauccgcaacggcaccuacgaccacgacgucuaccgggacgaggcgcugaacaaccgcuuccagaucaagggcguggagcucaagagcggguacaaggacuggauccuguggaucuccuucgccaucagcugcuuccugcucugcgucgugcugcugggcuucaucaugugggccugccagaaggggaacauccggugcaacaucugcaucuga

SEQ ID NO: 1347 - RNA, 1701 nt, Artificial Sequence
  derived and/or modified CDS sequence (AUadapt) from InfluenzaA__ABG80150__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgagaacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagcggcaucuccaucuacuggacgaucgugaagcccggggacauccugcugaucaacucgaccggcaaccucaucgcgccccggggcuacuucaagauccgcaacgggaaguccagcaucaugcgguccgacgccccgaucggcaacugcucguccgagugcaucacccccaacgggagcauccccaacgacaagcccuuccagaacgugaaccgcaucaccuacggcgccugcccgcgguacgucaagcagaacacgcugaagcuggccaccgggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagagcacgcaggcggccaucgaccagaucaacgggaagcugaaccggcugaucgagaagaccaacgagaaguuccaccagaucgagaaggaguucuccgaggucgagggccgcauccaggaccucgagaaguacguggaggacaccaagaucgaccuguggucguacaacgccgggcugcucguggcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgcgugcaucggcagcauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 1348 - RNA, 1701 nt, Artificial Sequence
  derived and/or modified CDS sequence (AUadapt) from InfluenzaA__ABG80161__HA
augaagaccaucaucgcccugucguacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacaaggagugggaccuguucguggagcgcuccaaggccuacucgaacugcuaccccuacgacgugccggacuacgcgucccugcggagccucgucgccuccagcggcacgcuggaguucaucaacgaggacuucaacuggaccgggguggcccaggacggcaaguccuacgccugcaagcgcgggucggugaacuccuucuucagccggcugaacuggcuccacaagcuggaguacaaguaccccgcgcugaacgucaccaugcccaacaacggcaaguucgacaagcucuacaucuggggcgugcaccaccccuccaccgacucggaccagacgucccuguacgugcaggccagcgggcgcgucaccgugagcaccaagcggucccagcagaccgugaucccgaacaucggcuuccgccccuggguccgggggcugucgucccgcaucagcaucuacuggacgaucgugaagcccggcgacauccuccugaucaacuccaccgggaaccugaucgcgccccggggcuacuucaagauccgcaacggcaagucguccaucaugcggagcgacgccccgaucgggaacugcuccagcgagugcaucacccccaacggcuccauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugguggacgggugguacggcuuccgccaccagaacucggaggggaccggccaggccgccgaccugaaguccacgcaggcggccaucgaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccggccugcugguggcccucgagaaccagcacaccaucgaccugacggacucggagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcugugcgucgugcuccugggcuucaucaugugggccugccagaaggggaacauccgcugcaacaucugcaucuga

SEQ ID NO: 1349 - RNA, 1698 nt, Artificial Sequence
  derived and/or modified CDS sequence (AUadapt) from InfluenzaA__ABG80172__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacaacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 1350 - RNA, 1698 nt, Artificial Sequence
  derived and/or modified CDS sequence (AUadapt) from InfluenzaA__ABG80183__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucgggggccagcgggcccuguaccacacggagaacgccuacgugagcgucgugagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagucgcgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagucgaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 1351 - RNA, 1701 nt, Artificial Sequence
  derived and/or modified CDS sequence (AUadapt) from InfluenzaA__ABG80194__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggaguggaaccuguucguggagcggagcacggccuacuccaacugcuaccccuacgacgucccggacuacgcgucgcuccgcucccugguggccagcuccggcacccuggaguucaacaacgagucguucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucagcuccaucaucucgaucuacuggaccaucgugaagcccggcgacauccuccugaucaacuccaccggcaaccugaucgcgccccggggguacuucaagauccggagcggcaaguccucgaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucucggaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 1352 - RNA, 1701 nt, Artificial Sequence
  derived and/or modified CDS sequence (AUadapt) from InfluenzaA__ABG80205__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacguggccaugcccaacaacgagaaguucgacaagcuguacaucuggggcguccaccaccccagcaccgacuccgaccagaucucgcuguacgcccaggccccggggcgggugacggugagcaccaagcgcucccagcagaccgucauccccaacaucggcucgcggcccugggugcgcggcguguccagccggaucuccaucuacuggaccaucgucaagcccggggacauccuccugaucaacugcacgggcaaccugaucgccccgcgcggguacuucaagauccggucgggcaaguccagcaucaugcgcuccgacgcgucgaucggcaagugcaacuccgagugcaucacccccaacgggagcauccccaacgacaagcccuuccagaacgugaaccggaucaccuacggcgccugcccgcgcuacgugaagcagaacacccucaagcuggccacggggaugcggaacguccccgagaagcagacccgcggcaucuucggggccaucgccggcuucaucgagaacggcugggaggggaugguggacggcugguacggguuccggcaccagaacuccgagggcaccgggcaggcggccgaccugaaguccacccaggccgccaucaaccagaucaacggcaagcucaaccgccugaucgagaagacgaacgagaaguuccaccagaucgagaaggaguucuccgagguggagggccggauccaggaccuggagaaguacgucgaggacaccaagaucaaccucuggucguacaacgccgagcugcugguggcgcucgagaaccagcacaccaucgaccugaccgacuccgagaugaacaagcuguucgagcgcacgaagaagcagcuccgggagaacgccgaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggcgugccagaaggggaacauccgcugcaacaucugcaucuga

SEQ ID NO: 1353 - RNA, 1701 nt, Artificial Sequence
  derived and/or modified CDS sequence (AUadapt) from InfluenzaA__ABG80216__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcucccccaccggccgcaucugcgacucgccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcucgcugguggccuccagcggcacccuggaguucaacaacgaguccuucaacuggaccggcguggcccagaacgggaccucguccgccugcaagcggcgcagcaucaaguccuucuucucgcggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggcccccgggcgcgugaccgucucgaccaagcggagccagcagacggugauccccaacaucggcucccgccccugggugcgcggggucucgucccggaucagcaucuacuggaccaucgugaagccgggcgacauccuccugaucaacuccaccggcaaccugaucgcgccccggggguacuucaagauccgcucgggcaaguccagcaucaugcgguccaacacccccaucgggaagugcaacucggagugcaucacgcccaacggcuccaucccgaacgacaagcccuuccagaacgugaaccgcaucaccuacggcgccugcccccgguacgucaagcagaacacccucaagcuggccaccgggaugcgcaacgugcccgagaagcagacgcggggcaucuucggggccaucgccggcuucaucgagaacgggugggagggcaugguggacggcugguacggguuccgccaccagaacagcgagggcaccgggcaggccgccgaccugaaguccacccaggcggccaucaaccagaucaacggcaagcucaaccggcugaucgagaagaccaacgagaaguuccaccagaucgagaaggaguucucggaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgccgaggacaugggcaacggcugcuucaagaucuaccacaagugcgacaacgcgugcaucggguccauccggaacggcacguacgaccacgacgucuaccgcgacgaggcccugaacaaccgguuccagaucaaggggguggagcucaagucgggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 1354 - RNA, 1701 nt, Artificial Sequence; identical to SEQ ID NO: 885
  derived and/or modified CDS sequence (AUadapt) from InfluenzaA__ABG80227__HA

SEQ ID NO: 1355 - RNA, 1701 nt, Artificial Sequence; identical to SEQ ID NO: 761
  derived and/or modified CDS sequence (AUadapt) from InfluenzaA__ABG80238__HA

SEQ ID NO: 1356 - RNA, 1701 nt, Artificial Sequence; identical to SEQ ID NO: 761
  derived and/or modified CDS sequence (AUadapt) from InfluenzaA__ABG80249__HA

SEQ ID NO: 1357 - RNA, 1701 nt, Artificial Sequence; identical to SEQ ID NO: 761
  derived and/or modified CDS sequence (AUadapt) from InfluenzaA__ABG80260__HA

SEQ ID NO: 1358 - RNA, 1701 nt, Artificial Sequence
  derived and/or modified CDS sequence (AUadapt) from InfluenzaA__ABG80271__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccgggggcaucugcgacucgccccaccagauccucgacggggagaacugcacccugauggacgcccugcucggcgacccccagugcgacggcuuccagaacaagaagugggaccuguucguggagcgcucgaaggccuacuccaacugcuaccccuacgacgucccggacuacgcgagccugcggucccucguggccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucucgcuguacgcgcaggccuccggccggaucaccgugagcacgaagcgcucgcagcagaccgucaucccgaacaucggcucccggccccgcgugcgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 1359 - RNA, 1701 nt, Artificial Sequence; identical to SEQ ID NO: 836
  derived and/or modified CDS sequence (AUadapt) from InfluenzaA__ABG80282__HA

SEQ ID NO: 1360 - RNA, 1701 nt, Artificial Sequence; identical to SEQ ID NO: 488
  derived and/or modified CDS sequence (AUadapt) from InfluenzaA__ABG80293__HA

SEQ ID NO: 1361 - RNA, 1701 nt, Artificial Sequence
  derived and/or modified CDS sequence (AUadapt) from InfluenzaA__ABG80304__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccaacaacgaccagaucaaccuguacgcgcaggccucgggccggaucaccguguccacgaagcgcagccagcagaccgugaucccgaacaucggcucgcggccccgcguccgggacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1362 - RNA, 1701 nt, Artificial Sequence
  derived and/or modified CDS sequence (AUadapt) from InfluenzaA__ABG80315__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugauccagucguccagcaccgggggcaucugcgacucgccccaccagauccucgacggggagaacugcacccugaucgacgcccugcucggcgacccccagugcgacggcuuccagaacaagaagugggaccuguucgucgagcgcucgaaggccuacuccaacugcuaccccuacgacgugccggacuacgcgagccugcggucccucguggccucguccgggacgcuggaguucaacaacgagucguucaacuggaccggcgucacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucucgcuguacgcgcaggccuccggccggaucaccgucagcacgaagcgcucgcagcagaccgugaucccgaacaucggcucccggccccgcgugcgggacauccccucgcgcaucuccaucuacuggaccaucgucaagcccggggacaugcugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 1363 - RNA, 1701 nt, Artificial Sequence; identical to SEQ ID NO: 527
  derived and/or modified CDS sequence (AUadapt) from InfluenzaA__ABG80326__HA

SEQ ID NO: 1364 - RNA, 1701 nt, Artificial Sequence; identical to SEQ ID NO: 527
  derived and/or modified CDS sequence (AUadapt) from InfluenzaA__ABG80337__HA

SEQ ID NO: 1365 - RNA, 1701 nt, Artificial Sequence
  derived and/or modified CDS sequence (AUadapt) from InfluenzaA__ABG80359__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcgggagcuacgccugcaagcgcggcuccgugaacucguucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgucgcuguacgugcgcgccuccggccgggucaccgugagcaccaagcgcucgcagcagaccgugacgccgaacaucgggucccggcccuggguccgcggccucagcucccggaucucgaucuacuggaccaucgugaagcccggggacauccugcugaucaacuccaccggcaaccucaucgcgccccgcggcuacuucaagauccggaacgggaaguccuccaucaugcgcagcgacgccccgaucggcaacugcuccucggagugcaucacccccaacggguccauccccagcgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgccggguucaucgagaacggcugggaggggaugguggacggcugguacggguuccggcaccagaacuccgagggcacgggccaggccgccgaccucaagucgacccaggcggccgucgaccagaucaacgggaagcugaaccgccugaucgagcggaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacacgaucgaccugaccgacuccgagaugaacaagcuguucgagaagacccgcaagcagcuccgggagaacgccgaggacauggggaacggcugcuucaagaucuaccacaagugcgacaacgcgugcaucgggucgauccgcaacggcaccuacgaccacgacguguaccgggacgaggcccugaacaaccgcuuccagaucaagggcgucgagcucaaguccggguacaaggacuggauccuguggaucagcuucgccaucagcugcuuccugcucugcguggugcugcugggcuucaucaugugggccugccagaaggggaacauccggugcaacaucugcaucuga

SEQ ID NO: 1366 - RNA, 1701 nt, Artificial Sequence
  derived and/or modified CDS sequence (AUadapt) from InfluenzaA__ABG80370__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaaguccuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 1367 - RNA, 1701 nt, Artificial Sequence; identical to SEQ ID NO: 1298
  derived and/or modified CDS sequence (AUadapt) from InfluenzaA__ABG80392__HA

SEQ ID NO: 1368 - RNA, 1701 nt, Artificial Sequence; identical to SEQ ID NO: 1298
  derived and/or modified CDS sequence (AUadapt) from InfluenzaA__ABG80403__HA

SEQ ID NO: 1369 - RNA, 1701 nt, Artificial Sequence; identical to SEQ ID NO: 1298
  derived and/or modified CDS sequence (AUadapt) from InfluenzaA__ABG80414__HA

SEQ ID NO: 1370 - RNA, 1701 nt, Artificial Sequence; identical to SEQ ID NO: 1298
  derived and/or modified CDS sequence (AUadapt) from InfluenzaA__ABG80425__HA

SEQ ID NO: 1371 - RNA, 1701 nt, Artificial Sequence; identical to SEQ ID NO: 1028
  derived and/or modified CDS sequence (AUadapt) from InfluenzaA__ABG88289__HA

SEQ ID NO: 1372 - RNA, 1701 nt, Artificial Sequence
  derived and/or modified CDS sequence (AUadapt) from InfluenzaA__ABG88300__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccgaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucaccaagcgccccaaggugcgggaccaggagggccgcaucaacuacuacuggacgcuccuggagcccggcgacaccaucaucuucgaggccaacgggaaccugaucgcccccugguacgccuucgcccucucgcggggcuucggguccggcaucaucaccagcaacgcguccaugggcgagugcgacgccaagugccagaccccgcagggggccaucaacagcucccugcccuuccagaacgugcaccccgucacgaucggcgagugccccaaguacgugcgcucgaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacgcagaacgccaucgacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacucgaacgucaagaaccuguacgagaaggugaagacccagcugaagaacaacgcgaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacucgacgguggccuccagccucguccugcuggugucccucggggccaucagcuucuggaugugcuccaacggcagccugcagugccgcaucugcaucuga

SEQ ID NO: 1373 - RNA, 1701 nt, Artificial Sequence; identical to SEQ ID NO: 1156
  derived and/or modified CDS sequence (AUadapt) from InfluenzaA__ABG88311__HA

SEQ ID NO: 1374 - RNA, 1701 nt, Artificial Sequence
  derived and/or modified CDS sequence (AUadapt) from InfluenzaA__ABG88322__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccucgugcucccacaacggcaagagcuccuucuacaagaaccugcucuggcugacggagaagaacgggcuguaccccauccucagcaaguccuacgucaacaacaaggagaaggaggugcuggugcuguggggcguccaccaccccagcaacaucggggaccagcgggccaucuaccacaccgagaacgcguacgugucgguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccucgaacgccuccaugggcgagugcgacgccaagugccagaccccgcagggggccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucgacggcaucacgaacaaggucaacucggugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 1375 - RNA, 1701 nt, Artificial Sequence
  derived and/or modified CDS sequence (AUadapt) from InfluenzaA__ABG88333__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagucguccuggccgaagcacaacgucacccggggcgugacggccagcugcucccacaagggcaagagcuccuucuaccgcaaccuccuguggcugaccgagaagaacgggucguaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacccccgagaucucgaagcgcccgaagguccgggggcaggagggccgcaucaacuacuacuggacgcuccuggagcccggcgacaccaucaucuucgaggcgaacgggaaccugaucgcccccugguacgccuucgcccucucccggggcuucgggagcggcaucaucaccuccaacgccagcauggacgagugcgacgcgaagugccagacgccccagggcgccaucaacuccucgcugccguuccagaacgugcaccccgugaccaucggggagugccccaaguacguccgcuccaccaagcugcggauggugaccggccuccgcaacauccccagcauccagucccgggggcuguucggcgccaucgccggguucaucgagggcggcuggaccgggaugaucgacggcugguacggguaccaccaccagaacgagcagggcagcggguacgccgcggaccagaaguccacgcagaacgccaucaacggcaucaccaacaaggugaacagcgucaucgagaagaugaacacccaguucaccgccgugggcaaggaguucaacaagcuggagaagcgcauggagaaccucaacaagaagguggacgacggguuccuggacaucuggacguacaacgccgagcugcucguccugcuggagaacgagcggacccucgacuuccacgacuccaacgugaagaaccuguacgagaaggucaagucgcagcugaagaacaacgccaaggagaucggcaacgggugcuucgaguucuaccacaagugcaacaacgagugcauggagagcgugaagaacggcaccuacgacuacccgaaguacuccgaggagagcaagcucaaccgcgagaagaucgacggggugaagcuggaguccaugggcgucuaccagauccuggcgaucuacucgaccguggccuccagccucgugcugcuggucucccucggcgccaucagcuucuggaugugcuccaacgggagccugcagugccggaucugcaucuga

SEQ ID NO: 1376 - RNA, 1701 nt, Artificial Sequence
  derived and/or modified CDS sequence (AUadapt) from InfluenzaA__ABG88344__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagucguccuggccgaagcacaacgucacccgcggggugacggccagcugcucccacaagggcaagagcuccuucuaccggaaccuccuguggcugaccgagaagaacgggucguaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacccccgagaucucgaagcgcccgaagguccggaaccaggaggggcgcaucaacuacuacuggacgcuccuggagcccggcgacaccaucaucuucgaggcgaacggcaaccugaucgcccccugguacgccuucgcccucucccggggguucggcagcgggaucaucaccuccaacgccagcauggacgagugcgacgcgaagugccagacgccccagggcgccaucaacuccucgcugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgccgcggaccagaaguccacgcagaacgccaucaacgggaucaccaacaaggugaacagcgucaucgagaagaugaacacccaguucaccgccgugggcaaggaguucaacaagcuggagaagcgcauggagaaccucaacaagaagguggacgacggcuuccuggacaucuggacguacaacgccgagcugcucguccugcuggagaacgagcggacccucgacuuccacgacuccaacgugaagaaccuguacgagaaggucaagucgcagcugaagaacaacgccaaggagaucgggaacggcugcuucgaguucuaccacaagugcaacaacgagugcauggagagcgugaagaacgggaccuacgacuacccgaaguacuccgaggagagcaagcucaaccgcgagaagaucgacggcgugaagcuggaguccaugggggucuaccagauccuggcgaucuacucgaccguggccuccagccucgugcugcuggucucccucggcgccaucagcuucuggaugugcuccaacggcagccugcagugccggaucugcaucuga

SEQ ID NO: 1377 - RNA, 1701 nt, Artificial Sequence
  derived and/or modified CDS sequence (AUadapt) from InfluenzaA__ABG88355__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucgucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacucgaacugcuacccguacgacgugcccgacuacgcgucccuccggagccuggucgccuccucgggcacgcuggaguucaccaacgagaacuucaacuggaccgggguggcccaggacggcaaguccuacgccugcaagcgcgggagcgugaacuccuucuucucgcggcucaacuggcugcacaagcuggaguacaaguaccccgcgcucaacgucaccaugcccaacaacggcaaguucgacaagcuguacaucuggggcgugcaccacccguccacggacagcgaccagaccucccuguacgugcgcgccucggggaaggucaccguguccaccaagcggagccagcagacggugauccccgacaucggcuaccgccccuggguccgggggcucucgucccgcaucagcaucuacuggaccaucgugaagcccggcgacauccugcugaucaacuccaccgggaaccucaucgccccgcggggcuacuucaagauccgcaacggcgagucguccaucaugcggagcgacgcccccaucgggaacugcuccucggagugcaucacccccaacggcuccauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacagcgaggggacgggccaggccgccgaccucaaguccacccaggcggccaucgaccagaucaacggcaagcugaaccggcuggucgagaagaccaacgagaaguuccaccagaucgagaaggaguucucggagguggaggggcgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagucgggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 1378 - RNA, 1701 nt, Artificial Sequence
  derived and/or modified CDS sequence (AUadapt) from InfluenzaA__ABG88366__HA
augaagaccaucaucgcccugucguacuuccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgagccuccggucccuggucgccucguccggcacgcuggaguucaccaacgagaacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccacccgagcacggacuccgaccagaccucgcuguacgugcgcgccuccgggaaggucaccgugagcaccaagcggucccagcagacggugauccccgacaucggcuaccgccccuggguccgggggcucucgagccgcaucuccaucuacuggaccaucgugaagcccggcgacauccugcugaucaacucgaccgggaaccucaucgccccgcggggcuacuucaagauccgcaacggcaaguccagcaucaugcgguccgacgcccccaucgggaacugcucguccgagugcaucacccccaacggcagcauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 1379 - RNA, 1701 nt, Artificial Sequence; identical to SEQ ID NO: 1229
  derived and/or modified CDS sequence (AUadapt) from InfluenzaA__ABG88377__HA

SEQ ID NO: 1380 - RNA, 1701 nt, Artificial Sequence; identical to SEQ ID NO: 1229
  derived and/or modified CDS sequence (AUadapt) from InfluenzaA__ABG88388__HA

SEQ ID NO: 1381 - RNA, 1701 nt, Artificial Sequence
  derived and/or modified CDS sequence (AUadapt) from InfluenzaA__ABG88399__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggccuacuccaacugcuaccccuacgacgugccggacuacgcgagccuccggucccuggucgccucguccggcacgcuggaguucaccaaggagagcuucaacuggaccgggguggcccaggacggcaaguccuacgccugcaagcgcgggucggugaacuccuucuucagccggcucaacuggcugcacaagcuggaguacaaguaccccgcgcucaacgucaccaugcccaacaacgacaaguucgacaagcuguacaucuggggcgugcaccaccccuccacggacucggaccagaccucccuguacgugcaggccagcgggcgcgucaccgugucgaccaagcggucccagcagacggugaucccgaacaucggcagccgccccuggguccggggcaucuccucgcgcaucuccaucuacuggaccaucgugaagcccggggacauccuccugaucaacagcaccggcaaccugaucgcgccccggggguacuucaagauccgcaacggcaaguccucgaucaugcgguccgacgccccgaucggcaacugcaacagcgagugcaucacccccaacggguccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacucggagggcacggggcaggccgccgaccugaaguccacccaggcggccaucgaccagaucaacggcaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacucggagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcgucgugcuccugggcuucaucaugugggccugccagaaggggaacauccgcugcaacaucugcaucuga

SEQ ID NO: 1382 - RNA, 1701 nt, Artificial Sequence; identical to SEQ ID NO: 1269
  derived and/or modified CDS sequence (AUadapt) from InfluenzaA__ABG88410__HA

SEQ ID NO: 1383 - RNA, 1701 nt, Artificial Sequence; identical to SEQ ID NO: 1269
  derived and/or modified CDS sequence (AUadapt) from InfluenzaA__ABG88421__HA

SEQ ID NO: 1384 - RNA, 1701 nt, Artificial Sequence
  derived and/or modified CDS sequence (AUadapt) from InfluenzaA__ABG88432__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagaugcggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1385 - RNA, 1701 nt, Artificial Sequence; identical to SEQ ID NO: 1269
  derived and/or modified CDS sequence (AUadapt) from InfluenzaA__ABG88443__HA

SEQ ID NO: 1386 - RNA, 1701 nt, Artificial Sequence
  derived and/or modified CDS sequence (AUadapt) from InfluenzaA__ABG88454__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgcgaacagcuucuucucccggcucaacuggcugcacaagcuggaguacaaguaccccgcccucaacgugaccaugcccaacaacggcaaguucgacaagcuguacaucuggggcguccaccaccccagcaccgacuccgaccagacgucgcuguacgugcgcgccuccgggggcgugaccgucagcaccaagcggucgcagcagaccgugaucccgaacaucgggucccgccccugggugcggggccucagcucccgcaucucgaucuacuggacgaucgucaagcccggggacauccugcugaucaacuccaccggcaaccucaucgcgccccggggcuacuucaagauccgcagcgggaaguccagcaucaugcgguccgacgccucgaucggcaacugcuccagcgagugcaucaccccgaacggguccauccccaacgacaagcccuuccagaacgugaaccgcaucaccuacggcgccugcccccgguacgugaagcagaacacgcugaagcuggccaccgggaugcgcaacgucccggagaagcagacccggggcaucuucggcgccaucgccggguucaucgagaacggcugggaggggaugguggacggcugguacggguuccgccaccagaacucggagggcaccggccaggccgcggaccucaaguccacgcaggccgccaucgaccagaucaacgggaagcugaaccggcugaucggcaagaccaacgacaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacucggagaugaacaagcuguucgagcggacccgcaagcagcuccgcgagaacgcggaggacaugggcaacgggugcuucaagaucuaccacaagugcgacaacgccugcaucggcuccauccggaacggcaccuacgaccacgacguguaccgcgacgaggcccugaacaaccgguuccagaucaagggggucgagcucaagagcggcuacaaggacuggauccuguggaucagcuucgccaucuccugcuuccugcucugcgugguccugcugggguucaucaugugggccugccagaagggcaacauccgcugcaacaucugcaucuga

SEQ ID NO: 1387 - RNA, 1701 nt, Artificial Sequence
  derived and/or modified CDS sequence (AUadapt) from InfluenzaA__ABG88465__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacauccccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgagguggaggggcggauccaggaccucgagaaguacgucgaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucuccugcuuccugcucugcgugguccugcugggcuucaucaugugggccugccagaaggggaacauccggugcaacaucugcaucuga

SEQ ID NO: 1388 - RNA, 1701 nt, Artificial Sequence; identical to SEQ ID NO: 1269
  derived and/or modified CDS sequence (AUadapt) from InfluenzaA__ABG88476__HA

SEQ ID NO: 1389 - RNA, 1701 nt, Artificial Sequence; identical to SEQ ID NO: 1269
  derived and/or modified CDS sequence (AUadapt) from InfluenzaA__ABG88487__HA

SEQ ID NO: 1390 - RNA, 1701 nt, Artificial Sequence; identical to SEQ ID NO: 1269
  derived and/or modified CDS sequence (AUadapt) from InfluenzaA__ABG88498__HA

SEQ ID NO: 1391 - RNA, 1701 nt, Artificial Sequence; identical to SEQ ID NO: 1269
  derived and/or modified CDS sequence (AUadapt) from InfluenzaA__ABG88509__HA

SEQ ID NO: 1392 - RNA, 1701 nt, Artificial Sequence
  derived and/or modified CDS sequence (AUadapt) from InfluenzaA__ABG88520__HA
augaagaccaucaucgcccugucguacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacaaggagugggaccuguucguggagcgcuccaaggccuacucgaacugcuaccccuacgacgugccggacuacgcgucccugcggagccucgucgccuccucgggcacgcuggaguucaucaacgaggacuucaacuggaccgggguggcccaggacggcaaguccuacgccugcaagcgcgggagcgugaacuccuucuucucgcggcugaacuggcuccacaagcuggaguacaaguaccccgcgcugaacgucaccaugcccaacaacggcaaguucgacaagcucuacaucuggggcgugcaccaccccuccaccgacagcgaccagacgucccuguacgugcgcgccagcgggcgggucaccgugucgaccaagcgcucccagcagaccgugaucccgaacaucggcuuccggcccuggguccgcgggcugagcucccggaucucgaucuacuggacgaucgugaagcccggcgacauccuccugaucaacuccaccgggaaccugaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccugaaguccacgcaggcggccaucgaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccggccugcugguggcccucgagaaccagcacaccaucgaccugacggacucggagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaagggcguggagcucaagagcggguacaaggacuggauccuguggaucuccuucgccaucagcugcuuccugcugugcgucgugcuccugggcuucaccaugugggccugccagaaggggaacauccggugcaacaucugcaucuga

SEQ ID NO: 1393 - RNA, 1701 nt, Artificial Sequence
  derived and/or modified CDS sequence (AUadapt) from InfluenzaA__ABG88531__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacucgccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgugcagacgucgcuguacguccgcgccuccgggcgggugaccgugagcaccaagcgcagccagcagaccgucaucccgaacaucggcuuccggcccugggugcgcgggcucuccucgcggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgucaaccggaucaccuacggggccugcccgcgcuacgugaagcagaacacgcugaagcuggccaccggcaugcggaacgugcccgagaagcagacccgcgggaucuucggcgccaucgccggcuucaucgagaacgggugggagggcauggucgacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgagguggaggggcggauccaggaccucgagaaguacguggaggacaccaagaucgaccuguggucguacaacgccggccugcucgucgcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucuccugcuuccugcucugcguggugcugcugggcuucaucaugugggccugccagaaggggaacauccggugcaacaucugcaucuga

SEQ ID NO: 1394 - RNA, 1698 nt, Artificial Sequence; identical to SEQ ID NO: 1280
  derived and/or modified CDS sequence (AUadapt) from InfluenzaA__ABG88553__HA

SEQ ID NO: 1395 - RNA, 1701 nt, Artificial Sequence; identical to SEQ ID NO: 955
  derived and/or modified CDS sequence (AUadapt) from InfluenzaA__ABG88564__HA

SEQ ID NO: 1396 - RNA, 1701 nt, Artificial Sequence; identical to SEQ ID NO: 985
  derived and/or modified CDS sequence (AUadapt) from InfluenzaA__ABG88575__HA

SEQ ID NO: 1397 - RNA, 1701 nt, Artificial Sequence; identical to SEQ ID NO: 895
  derived and/or modified CDS sequence (AUadapt) from InfluenzaA__ABG88586__HA

SEQ ID NO: 1398 - RNA, 1701 nt, Artificial Sequence
  derived and/or modified CDS sequence (AUadapt) from InfluenzaA__ABG88597__HA
augaagaccaucaucgcccugucguacauccucugccugguguucgcccagaagcugcccgcgaacgacaacuccaccgccacgcucugccugggccaccacgccgucccgaacgggacccuggugaagaccaucaccaacgacaacaucgaggugacgaacgccaccgagcucguccagucguccagcaccggccgcaucugcgacucgccccaccagauccuggacggggagaacugcacccugaucgacgcccuccugggcgacccccacugcgacggguuccagaacaaggagugggaccuguucguggagcggagcacggcguacuccaacugcuaccccuacgacgugccggacuacgccucgcuccgcucccuggucgccagcuccggcacccuggaguucaacaacgagucguucaacuggaccggcguggaccagaacgggaccuccagcgccugcaagcggcgcuccaacaagucguucuucucccggcucaacuggcugcaccagcugaaguacaaguaccccgcgcucaacgugacgaugcccaacaacgagaaguucgacaagcuguacaucuggggcguccaccaccccagcaccgacuccgaccagaucucgcuguacgcccaggccagcgggcgcgugaccguguccaccaagcggucgcagcagacggucaucccgaacaucggcucccgccccugggugcgcggggugagcucccggaucucgaucuacuggaccaucgucaagcccggcgacauccuccugaucaacuccaccggcaaccugaucgcgccccggggguacuucaagauccgcagcggcaaguccucgaucaugcgguccaacgccccgaucgggaagugcaacagcgagugcaucacccccaacggcuccauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacgggugggagggcaugguggacggcugguacggguuccgccaccagaacucggagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacucggagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggguucaucaugugggccugccagaagggcaacauccgcugcaacaucugcaucuga

SEQ ID NO: 1399 - RNA, 1701 nt, Artificial Sequence
  derived and/or modified CDS sequence (AUadapt) from InfluenzaA__ABG88608__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucucgcuccggucccugguggcgagcuccggcacgcuggaguucaacaacgagucguucaacuggaccgggguggcccagaacggcaccuccagcgccugcaagcgccgguccgacaagucguucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgggugaccgucagcaccaagcgcucccagcagaccgugaucccgaacaucggcucgcggcccugggugcgcggcgucuccagccggaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgcgagaacgccgaggacauggggaacggcugcuucaagaucuaccacaagugcgacaacgccugcaucgggagcauccggaacggcaccuacgaccacgacguguaccgcgacgaggcgcugaacacccgguuccagaucaagggggucgagcugaaguccggcuacaaggacuggauccucuggaucucguucgccaucagcugcuuccugcugugcaucgugcuccugggcuucaucaugugggccugccagaaggggaacauccgcugcaacaucugcaucuga

SEQ ID NO: 1400 - RNA, 1701 nt, Artificial Sequence; identical to SEQ ID NO: 807
  derived and/or modified CDS sequence (AUadapt) from InfluenzaA__ABG88619__HA

SEQ ID NO: 1401 - RNA, 1701 nt, Artificial Sequence
  derived and/or modified CDS sequence (AUadapt) from InfluenzaA__ABG88630__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccaggugcuggacggcgagaacugcacccugaucgacgcccuccugggggacccccacugcgacggcuuccagaacaaggagugggaccuguucguggagcggagcaaggccuacuccaacugcuaccccuacgacgucccggacuacgugucgcuccgcucccugguggcgagcuccggcacgcuggaguucaacaacgagucguucaacuggaccggggucgcccagaacggcaccuccagcgccugcaagcggcgcuccgacaagucguucuucucccggcucaacuggcugcaccagcugaaguacaaguaccccgcccucaacgugaccaugcccaacaacgagaaguucgacaagcuguacaucuggggcgugcaccaccccgggacggacagcgaccagaucucccuguacgcgcaggccucggggcgcgucaccgugagcaccaagcggucccagcagaccgugaucccgaacaucggcucgcgccccuggguccggggcguguccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgucaaccgcaucaccuacggcgccugcccgcgguacgugaagcagaagacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucucguucgccaucagcugcuuccugcugugcaucguccuccugggcuucaucaugugggccugccagaaggggaacauccggugcaacaucugcaucuga

SEQ ID NO: 1402 - RNA, 1701 nt, Artificial Sequence
  derived and/or modified CDS sequence (AUadapt) from InfluenzaA__ABG88641__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccucccgcaucugcgacucgccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcucgcugguggcguccagcggcacgcuggaguucaacaacgaguccuucaacuggaccggcguggcccagaacgggaccucguccgccugcaagcggcgcagcgacaaguccuucuucucgcggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccucgggccgcgugaccgucuccaccaagcggagccagcagaccgugaucccgaacaucggguccggccccugggugcgcggcgucucgucccggaucagcaucuacuggacgaucgugaagcccggggacauccuccugaucaacuccaccggcaaccugaucgcgccccgcggguacuucaagauccggucgggcaaguccagcaucaugcgcuccgacgccccgaucggcaagugcaacucggagugcaucacccccaacggguccauccccaacggcaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacagcgaggggaccggccaggccgccgaccugaaguccacgcaggcggccaucaaccagaucaacggcaagcucaaccgccugaucgagaagaccaacgagaaguuccaccagaucgagaaggaguucucggagguggaggggcggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacaugggcaacgggugcuucaagaucuaccacaagugcgacaacgcgugcaucggcuccauccgcaacgggaccuacgaccacgacguguaccgcgacgaggcccugaacaaccgguuccagaucaagggcgucgagcucaagucgggcuacaaggacuggauccuguggaucagcuucgccaccuccugcuuccugcugugcaucgugcuccugggguucaucaugugggccugccagaagggcaacauccgcugcaacaucugcaucuga

SEQ ID NO: 1403 - RNA, 1701 nt, Artificial Sequence; identical to SEQ ID NO: 761
  derived and/or modified CDS sequence (AUadapt) from InfluenzaA__ABG88652__HA

SEQ ID NO: 1404 - RNA, 1701 nt, Artificial Sequence; identical to SEQ ID NO: 761
  derived and/or modified CDS sequence (AUadapt) from InfluenzaA__ABG88663__HA

SEQ ID NO: 1405 - RNA, 1701 nt, Artificial Sequence; identical to SEQ ID NO: 761
  derived and/or modified CDS sequence (AUadapt) from InfluenzaA__ABG88674__HA

SEQ ID NO: 1406 - RNA, 1701 nt, Artificial Sequence; identical to SEQ ID NO: 761
  derived and/or modified CDS sequence (AUadapt) from InfluenzaA__ABG88685__HA

SEQ ID NO: 1407 - RNA, 1701 nt, Artificial Sequence; identical to SEQ ID NO: 761
  derived and/or modified CDS sequence (AUadapt) from InfluenzaA__ABG88696__HA

SEQ ID NO: 1408 - RNA, 1701 nt, Artificial Sequence; identical to SEQ ID NO: 527
  derived and/or modified CDS sequence (AUadapt) from InfluenzaA__ABG88707__HA

SEQ ID NO: 1409 - RNA, 1701 nt, Artificial Sequence; identical to SEQ ID NO: 527
  derived and/or modified CDS sequence (AUadapt) from InfluenzaA__ABG88718__HA

SEQ ID NO: 1410 - RNA, 1701 nt, Artificial Sequence
  derived and/or modified CDS sequence (AUadapt) from InfluenzaA__ABG88729__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcgggucguacgccugcaagcgcggcuccgugaacagcuucuucucccggcucaacuggcugcacaagcuggaguacaaguaccccgcgcucaacgucaccaugcccaacucggggaaguucgacaagcuguacaucuggggcgugcaccaccccuccaccgacagcgaccagacgucccuguacgugcgcgccucgggccgggucaccgugagcaccaagcgcucccagcagaccgugacgccgaacaucgggucgcggcccuggguccgcggccucuccagccggaucuccaucuacuggaccaucgugaagcccggggacauccugcugaucaacucgaccggcaaccucaucgcgccccgcggcuacuucaagauccggaacgggaaguccagcaucaugcgcuccgacgccccgaucggcaacugcucguccgagugcaucacccccaacgggagcauccccaacgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgccggguucaucgagaacggcugggaggggaugguggacggcugguacggguuccggcaccagaacuccgagggcacgggccaggccgccgaccucaagucgacccaggcggccaucgaccagaucaacgggaagcugaaccgccugaucgagaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagacccgcaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgguuccagaucaagggcguggagcucaaguccggguacaaggacuggauccuguggaucagcuucgccaucagcugcuuccugcucugcgucgugcugcugggcuucaucaugugggccugccagaaggggaacauccgcugcaacaucugcaucuga

SEQ ID NO: 1411 - RNA, 1701 nt, Artificial Sequence
  derived and/or modified CDS sequence (AUadapt) from InfluenzaA__ABG88740__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacaucaagcagaacacgcugaagcuggccaccggcaugcggaacguccccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugaucgagaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcgugguccugcugggguucaucaugugggccugccagaagggcaacauccggugcaacaucugcaucuga

SEQ ID NO: 1412 - RNA, 1701 nt, Artificial Sequence; identical to SEQ ID NO: 1298
  derived and/or modified CDS sequence (AUadapt) from InfluenzaA__ABG88751__HA

SEQ ID NO: 1413 - RNA, 1701 nt, Artificial Sequence
  derived and/or modified CDS sequence (AUadapt) from InfluenzaA__ABG88762__HA
augaagaccaucaucgcccugucguacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagagcuccucgaccgggcgcaucugcgacagcccccaccggauccuggacggcaagaacugcacgcugaucgacgcccuccugggggacccccacugcgacggcuuccagaacaaggagugggaccuguucguggagcgcucgaaggccuacuccaacugcuaccccuacgacgugccggacuacgccagccuccggucccuggucgcgucguccggcacccuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcccucaacgucaccaugcccaacaacgggaaguucgacaagcuguacaucuggggcgugcaccaccccucgacggacuccgaccagaccagccuguacgugcgcgcguccggccgggucaccgugucgaccaagcgcagccagcagacggugaucccgaacaucgggucccggcccuggguccgcggccucucgucccggaucagcaucuacuggaccaucgugaagcccggggacauccugcugaucaacuccaccggcaaccucaucgcgccccgcggcuacuucaagauccggaacgggaaguccuccaucaugcgcagcgacgccuccaucggcaacugcucguccgagugcaucaccccgaacgggagcauccccaacgacaagcccuuccagaacgugaaccggaucacguacggcgccugcccccgcuacgucaagcagaacacccugaagcuggccaccgggaugcggaacgugccggagaagcagacccgcggcaucuucggcgccaucgccggguucaucgagaacggcugggaggggaugguggacggcugguacggguuccggcaccagaacuccgagggcacgggccaggccgccgaccucaagucgacccaggccgcgaucgaccagaucaacgggaagcugaaccgccugaucgagaagaccaacgagaaguuccaccagaucgagaaggaggucuccgagguggagggccggauccaggaccucgagaaguacguggaggacaccaagaucgaccuguggagcuacaacgccgagcugcucgucgcccuggagaaccagcacacgaucgaccugaccgacuccgagaugaacaagcuguucgagcgcacccgcaagcagcuccgggagaacgccgaggacauggggaacggcugcuucaagaucuaccacaagugcgacaacgccugcaucgggucgauccgcaacggcaccuacgaccacgacguguaccgggacgaggcgcugaacaaccgcuuccagaucaaguccgucgagcucaagagcggcuacaaggacuggauccuguggaucagcuucgccaucuccugcuuccugcucugcguggugcugcugggguucaucaugugggccugccagaagggcaacauccggugcaacaucugcaucuga

SEQ ID NO: 1414 - RNA, 1701 nt, Artificial Sequence
  derived and/or modified CDS sequence (AUadapt) from InfluenzaA__ABG88773__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucggccgggcgcaucugcgacagcccccaccggauccuggacggcaagaacugcacccugaucgacgcccuccugggggacccccacugcgacggcuuccagaacaaggagugggaccuguucguggagcgcuccaaggcguacuccaacugcuaccccuacgacgugccggacuacgccucgcuccggucccuggucgccagcuccggcacccuggaguucaucaacgaggacuucaacuggacggggguggcccaggacggcaagucguacgcgugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccaccccucgaccgacuccgaccagaccagccuguacgugcgcgccuccgggcgggucacggugucgaccaagcgcagccagcagaccgugaucccgaacaucggcucccggcccuggguccgcgggcucucgucccggaucagcaucuacuggaccaucgugaagcccggcgacauccugcugaucaacuccacggggaaccucaucgcgccccgcggcuacuucaagauccggaacggcaagucguccaucaugcgcagcgacgccccgaucgggaacugcuccucggagugcaucacccccaacggcuccauccccaacgacaagcccuuccagaacgugaaccggaucaccuacggggccugcccgcgcuacgucaagcagaacacccugaagcuggccacgggcaugcggaacgugcccgagaagcagacccgcgggaucuucggcgccaucgccggcuucaucgagaacgggugggagggcaugguggacgggugguacggcuuccggcaccagaacagcgaggggaccggccaggccgcggaccucaaguccacccaggccgccacggaccagaucaacggcaagcugaaccgccugaucgagaagaccaacgagaaguuccaccagaucgagaaggaguucucggaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagucgggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 1415 - RNA, 1701 nt, Artificial Sequence
  derived and/or modified CDS sequence (AUadapt) from InfluenzaA__ABG88784__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugaucaagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 1416 - RNA, 1701 nt, Artificial Sequence
  derived and/or modified CDS sequence (AUadapt) from InfluenzaA__ABG88806__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccgugcccaacaacgagaaguucgacaagcuguacaucuggggcgugcaccaccccgggacggacagcgaccagaucucccuguacgcgcaggccucggggcgcgucaccgugagcaccaagcggucccagcagaccgugaucccgaacaucggcucgcgccccuggguccggggcguguccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgucaaccgcaucaccuacggcgccugcccgcgguacgugaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucucguucgccaucagcugcuuccugcugugcaucguccuccugggcuucaucaugugggccugccagaaggggaacauccggugcaacaucugcaucuga

SEQ ID NO: 1417 - RNA, 1704 nt, Artificial Sequence
  derived and/or modified CDS sequence (AUadapt) from InfluenzaA__ABI16504__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucaucagcaaguccucgugguccgaccacgaggccagcuccggcgucucguccgcgugcccguaccagggcacccccagcuucuuccgcaacgugguguggcugaucaagaagaacaacacguaccccaccaucaagcgguccuacaacaacaccaaccaggaggaccuccugauccugugggggauccaccacagcaacaacgccgccgagcagaccaagcucuaccagaaccccacgaccuacaucuccgucggcaccucgacccugaaccugcgccucgugccgaagaucgccacgcgguccaaggugaacgggcagagcggccgcauggacuucuucuggaccauccugaagcccaacgacgcgaucaacuucgagucgaacgggaacuucaucgcccccgaguacgccuacaagaucgucaagaagggcgacuccgccaucaugaaguccgagguggaguacggcaacugcaacaccaagugccagacccccaucggggccaucaacagcucgaugccguuccacaacauccacccccugacgaucggcgagugccccaaguacgugaaguccaacaagcucguccuggcgaccgggcugcggaacagcccccuccgcgagcggcgccggaagcgcggccuguucggcgccaucgccggguucaucgagggcggguggcagggcaugguggacgggugguacggcuaccaccacuccaacgagcagggcagcggguacgccgccgacaaggaguccacccagaaggcgaucgacggcgugaccaacaaggucaacucgaucaucgacaagaugaacacgcaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacuccaacgugaagaaccucuacgacaagguccggcugcagcugcgcgacaacgccaaggagcucgggaacggcugcuucgaguucuaccacaagugcgacaacgagugcauggagagcgugcggaacggcaccuacgacuacccgcaguacuccgaggaggcccgccugaagcgggaggagaucucgggggugaagcuggaguccaucggcacguaccagauccucagcaucuacuccaccgucgcgucgucccuggcccuggccaucaugguggccgggcucagccuguggaugugcagcaacggcucccugcagugccgcaucugcaucuga

SEQ ID NO: 1418 - RNA, 1701 nt, Artificial Sequence; identical to SEQ ID NO: 878
  derived and/or modified CDS sequence (AUadapt) from InfluenzaA__ABI20793__HA

SEQ ID NO: 1419 - RNA, 1701 nt, Artificial Sequence
  derived and/or modified CDS sequence (AUadapt) from InfluenzaA__ABI20837__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacucgaacgucaagaaccuguacgagaaggugaagacccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 1420 - RNA, 1701 nt, Artificial Sequence
  derived and/or modified CDS sequence (AUadapt) from InfluenzaA__ABI20848__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagucgcuguucuccaaggagagcugguccuacaucgccgagacccccaaccccgagaacggcacgugcuaccccggcuacuucgccgacuacgaggagcucaaggagcagcugagcuccgucucguccuucgagcgguucgagaucuucccgaaggagagcuccuggcccaaccacaccgugaccaagggggugaccgccagcugcucccacaacggcaagucguccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgcgccaucuaccacaccgagaacgcgcacgugucgguggucuccagccacuacucccggcgcuucaccccggagaucgccaagcggcccaaggugcgcgaccaggagggccggaucaacuacuacuggacccuccuggagcccggcgacacgaucaucuucgaggccaacgggaaccugaucgcccccugguacgccuucgcgcucagccgcggcuucggguccggcaucaucaccucgaacgccuccaugggcgagugcgacgccaagugccagaccccgcagggggccaucaacagcucccugcccuuccagaacgugcaccccgucaccaucggcgagugccccaaguacgugcggagcacgaagcugcgcauggugaccgggcuccggaacaucccguccauccagucgcgcggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcggcgcauggagaaccucaacaagaaggucgacgacggcuuccuggacaucuggaccuacaacgcggagcugcucgugcugcuggagaacgagcggacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacucggaggaguccaagcucaagcgcgagaagaucgacggcgucaagcuggagagcaugggcguguaccagauccuggccaucuacagcaccguggccuccucgcucguccugcuggugucccucggggccaucagcuucuggaugugcuccaacggcagccugcagugccggaucugcaucuga

SEQ ID NO: 1421 - RNA, 1701 nt, Artificial Sequence; identical to SEQ ID NO: 1166
  derived and/or modified CDS sequence (AUadapt) from InfluenzaA__ABI20859__HA

SEQ ID NO: 1422 - RNA, 1701 nt, Artificial Sequence
  derived and/or modified CDS sequence (AUadapt) from InfluenzaA__ABI20870__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucuccaaggagucgugguccuacaucgccgagacccccaaccccgagaacgggaccugcuaccccggcaacuucgccgacuacgaggagcuccgggagcagcugagcuccgucagcuccuucgagcgcuucgagaucuucccgaaggagagcuccuggcccaaccacacggugaccaagggggugaccgucucgugcucccacaacggcaagagcuccuucuaccggaaccugcucuggcugaccgagaagaacgggcuguaccccaaccucagcaaguccuacgugaacaacaaggagaaggaggugcugguccuguggggcgugcaccaccccagcaacaugcgcgaccagcgggccaucuaccacacggagaacgccuacgugucggucguguccagccacuacucccgccgguucaccccggagaucgcgaagcgccccaaggugcgggaccaggaggggcgcaucaacuacuacuggacccuccuggagcccggcgacaccaucaucuucgaggccaacggcaaccugaucgcgccccgguacgccuucgcccucagccgcggguucggcuccgggaucaucacgucgaacgccuccauggacgagugcgacgccaagugccagaccccgcagggcgccaucaacagcucccugcccuuccagaacguccaccccgugaccaucggcgagugccccaaguacgugcggagcaccaagcugcgcauggucacggggcuccggaacaucccguccauccagagccgcggccuguucggggccaucgccggcuucaucgagggcggcuggaccggcaugaucgacgggugguacggcuaccaccaccagaacgagcagggguccggcuacgcggccgaccagaaguccacccagaacgccaucaacgggaucaccaacaaggugaacucggugaucgagaagaugaacacgcaguucaccgccgucggcaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacaacgagugcauggagagcgucaagaacgggacguacgacuaccccaaguacuccgaggagagcaagcucaaccgcgagaagaucgacggcgugaagcuggagucgauggggguguaccagauccuggccaucuacuccaccgucgccagcucccucgugcugcuggugagccucggcgccaucuccuucuggaugugcagcaacggcucccugcagugccggaucugcaucuga

SEQ ID NO: 1423 - RNA, 1701 nt, Artificial Sequence; identical to SEQ ID NO: 1234
  derived and/or modified CDS sequence (AUadapt) from InfluenzaA__ABI20881__HA

SEQ ID NO: 1424 - RNA, 1701 nt, Artificial Sequence
  derived and/or modified CDS sequence (AUadapt) from InfluenzaA__ABI20892__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaaggagggguucaacuggaccggcguggcccaggacgggaaguccuacgccugcaagcgcggcuccgugaacucguucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcauccacuggaccaucgugaagcccggcgacauccuccugaucaccuccaccgggaaccugaucgcgccccggggcuacuucaagauccgcaacggcaagucguccaucaugcggucggacgccccgaucgggaacugcaacuccgagugcaucacgcccaacggcagcauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacuccgaggggaccggccaggccgccgaccucaagucgacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggacguacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 1425 - RNA, 1701 nt, Artificial Sequence
  derived and/or modified CDS sequence (AUadapt) from InfluenzaA__ABI20903__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacucgcccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgucgcuccggucccuggucgccagcuccggcacgcuggaguucaccaacgagaacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccacccgucgacggacuccgaccagaccagccuguacgugcgcgccuccgggaaggucaccgugucgaccaagcggucccagcagacggugauccccgacaucggcuaccgccccuggguccgggggcucucgagccgcaucuccaucuacuggaccaucgugaagcccggcgacauccugcugauccacucgaccgggaaccucaucgccccgcggggcuacuucaagauccgcaacggcaaguccagcaucaugcgguccgacgcccccaucgggaacugcucguccgagugcaucacccccaacggcagcauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagucgacccaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 1426 - RNA, 1701 nt, Artificial Sequence
  derived and/or modified CDS sequence (AUadapt) from InfluenzaA__ABI20914__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggcgggucaccgugagcaccaagcgcagccagcagaccgugaucccgaacaucggcuuccggcccuggguccgcgggcucuccucgcggaucuccaucuacuggacgaucgugaagcccggcgacauccugcugaucaacagcaccgggaaccucaucgcgccccgcggcuacuucaagauccggaacggcaaguccucgaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagucgacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugagccugggcuucaucaugugggccugccagaaggggaacauccggugcaacaucugcaucuga

SEQ ID NO: 1427 - RNA, 1701 nt, Artificial Sequence; identical to SEQ ID NO: 1311
  derived and/or modified CDS sequence (AUadapt) from InfluenzaA__ABI20925__HA

SEQ ID NO: 1428 - RNA, 1701 nt, Artificial Sequence; identical to SEQ ID NO: 1311
  derived and/or modified CDS sequence (AUadapt) from InfluenzaA__ABI20936__HA

SEQ ID NO: 1429 - RNA, 1701 nt, Artificial Sequence
  derived and/or modified CDS sequence (AUadapt) from InfluenzaA__ABI20947__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugucgaccaagcgcagccagcagaccgugaucccgaacaucggcuuccggcccuggguccgcgggcucuccagccggaucuccaucuacuggacgaucgugaagcccggcgacauccugcugaucaacucgaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagcaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1430 - RNA, 1701 nt, Artificial Sequence
  derived and/or modified CDS sequence (AUadapt) from InfluenzaA__ABI20958__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacucgccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagucguacgccugcaagcgcggguccgugaacagcuucuucucccggcucaacuggcuguacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggcgggucaccgugagcaccaagcgcagccagcagaccgugaucccgaacaucggcuuccggcccuggguccgcgggcucuccucgcggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggucguacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 1431 - RNA, 1701 nt, Artificial Sequence
  derived and/or modified CDS sequence (AUadapt) from InfluenzaA__ABI20969__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggaguggaaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 1432 - RNA, 1701 nt, Artificial Sequence
  derived and/or modified CDS sequence (AUadapt) from InfluenzaA__ABI20980__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggaccagaacgggaccuccucggccugcaagcggcgcuccacgaaguccuucuucucccggcucaacuggcugcaccagcugaaguacaaguaccccgcccucaacgucaccaugcccaacaacgagaaguucgacaagcuguacaucuggggcgugcaccaccccagcaccgacuccgaccagaucucgcuguacgcgcaggccagcgggcgcgugaccgucuccacgaagcggucgcagcagaccgugaccccgaacaucggcucccgccccugggugcgcggggucagcucccggaucucgaucuacuggaccaucgugaagcccggcgacauccuccugaucaacuccacgggcaaccugaucgcgccccggggguacuucaagauccgcagcggcaaguccucgaucaugcgguccaacgcccucaucgggaagugcaacagcgagugcaucaccccgaacggcuccauccccaacgacaagcccuuccagaacgugaaccgcaucaccuacggcgccugcccccgguacgucaagcagaacacccugaagcuggccacggggaugcgcaacgugccggagaagcagacccggggcaucuucggggccaucgccggcuucaucgagaacgggugggagggcaugguggacggcugguacggguuccgccaccagaacucggagggcaccgggcaggccgccgaccucaaguccacccaggcggccaucaaccagaucaacggcaagcugaaccggcugaucgagaagacgaacgagaaguuccaccagaucgagaaggaguucagcgaggucgaggggcgcauccaggaccucgagaaguacguggaggacaccaagaucgaccugugguccuacaacgccgagauccugguggcccucgagaaccagcacaccaucgaccugaccgacucggagaugaacaagcuguucgagcggacgcgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcugugcgucgugcuccugggguucaucaugugggccugccagaagggcaacauccgcugcaacaucugcaucuga

SEQ ID NO: 1433 - RNA, 1701 nt, Artificial Sequence
  derived and/or modified CDS sequence (AUadapt) from InfluenzaA__ABI20991__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagccggaucuccaucuacuggacgaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaucaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggccugccagaaggggaacauccgcugcaacaucugcaucuga

SEQ ID NO: 1434 - RNA, 1701 nt, Artificial Sequence; identical to SEQ ID NO: 955
  derived and/or modified CDS sequence (AUadapt) from InfluenzaA__ABI21002__HA

SEQ ID NO: 1435 - RNA, 1701 nt, Artificial Sequence; identical to SEQ ID NO: 1399
  derived and/or modified CDS sequence (AUadapt) from InfluenzaA__ABI21013__HA

SEQ ID NO: 1436 - RNA, 1701 nt, Artificial Sequence; identical to SEQ ID NO: 885
  derived and/or modified CDS sequence (AUadapt) from InfluenzaA__ABI21024__HA

SEQ ID NO: 1437 - RNA, 1701 nt, Artificial Sequence; identical to SEQ ID NO: 761
  derived and/or modified CDS sequence (AUadapt) from InfluenzaA__ABI21035__HA

SEQ ID NO: 1438 - RNA, 1701 nt, Artificial Sequence
  derived and/or modified CDS sequence (AUadapt) from InfluenzaA__ABI21046__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccucguccgggacgcuggaguucaacaacgagagcuucgacuggaccggcgugacccagaacgggaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 1439 - RNA, 1701 nt, Artificial Sequence
  derived and/or modified CDS sequence (AUadapt) from InfluenzaA__ABI21057__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgcgucccugcggucgcucgucgccuccucggggacgcuggaguucaacaacgaguccuucgacuggaccggcgugacccagaacgggaccucguccgccugcaagcgccggagcaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucucgaucuacuggaccaucgugaagcccggggacauccugcucaucaacuccaccggcaaccugaucgcgccccggggguacuucaagauccgcagcggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 1440 - RNA, 1701 nt, Artificial Sequence; identical to SEQ ID NO: 488
  derived and/or modified CDS sequence (AUadapt) from InfluenzaA__ABI21068__HA

SEQ ID NO: 1441 - RNA, 1701 nt, Artificial Sequence; identical to SEQ ID NO: 527
  derived and/or modified CDS sequence (AUadapt) from InfluenzaA__ABI21079__HA

SEQ ID NO: 1442 - RNA, 1701 nt, Artificial Sequence; identical to SEQ ID NO: 1358
  derived and/or modified CDS sequence (AUadapt) from InfluenzaA__ABI21090__HA

SEQ ID NO: 1443 - RNA, 1701 nt, Artificial Sequence; identical to SEQ ID NO: 1358
  derived and/or modified CDS sequence (AUadapt) from InfluenzaA__ABI21101__HA

SEQ ID NO: 1444 - RNA, 1701 nt, Artificial Sequence
  derived and/or modified CDS sequence (AUadapt) from InfluenzaA__ABI21123__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccaacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaagcacguggaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 1445 - RNA, 1701 nt, Artificial Sequence
  derived and/or modified CDS sequence (AUadapt) from InfluenzaA__ABI21134__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagucguccagcaccgggggcaucugcgacucgccccaccagauccucgacggggagaacugcacccugauggacgcccugcucggcgacccccagugcgacggcuuccagaacaagaagugggaccuguucguggagcgcucgaaggccuacuccaacugcuaccccuacgacgucccggacuacgcgagccugcggucccucguggccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcgcaggccuccggccggaucaccgugucgacgaagcgcucgcagcagaccgucaucccgaacaucggcucccggagccgcgugcgggacauccccucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 1446 - RNA, 1701 nt, Artificial Sequence; identical to SEQ ID NO: 527
  derived and/or modified CDS sequence (AUadapt) from InfluenzaA__ABI21156__HA

SEQ ID NO: 1447 - RNA, 1701 nt, Artificial Sequence
  derived and/or modified CDS sequence (AUadapt) from InfluenzaA__ABI21167__HA
augaagaccaucaucgcccugggcuacauccucugccugguguucgcccagaagcugcccgggaacgacaacucgaccgcgacgcucugccugggccaccacgccgucccgaacgggaccaucgugaagaccaucaccaacgaccagaucgaggugacgaacgccaccgagcugguccaguccucguccaccggcgggaucugcgacagcccccaccagauccucgacggcgagaacugcacccugaucgacgcccugcucggcgacccccagugcgacggguuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucaacuggaccggggugacccagaacggcaccucguccgccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccaacaacgaccagaucucccuguacgcgcaggccucgggccggaucaccguguccacgaagcgcucgcagcagaccgugaucccgaacaucgggagccggccccgcguccgggacauccccucccgcaucucgaucuacuggaccaucgugaagcccggcgacauccugcucaucaacuccaccgggaaccugaucgccccgcggggcuacuucaagauccgcucgggcaaguccagcaucaugcgguccgacgcccccaucgggaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggcuucaucgagaacgggugggagggcaugguggacgggugguacggcuuccgccaccagaacucggaggggaucggccaggccgccgaccugaaguccacccaggcggccaucaaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgaggucuaccgggacgaggcccucaacaaccgcuuccagaucaagggcguggagcucaagucgggguacaaggacuggauccuguggaucuccuucgccaucagcugcuuccugcugugcguggcccugcucggcuucaucaugugggccugccagaaggggaacauccggugcaacaucugcaucuga

SEQ ID NO: 1448 - RNA, 1701 nt, Artificial Sequence
  derived and/or modified CDS sequence (AUadapt) from InfluenzaA__ABI21178__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccucgugcuaccccuacgacgugccggacuacgcgucccugcggucgcucgucgccuccagcgggacgcuggaguucaacaacgaguccuucaacuggaccggcgugacccagaacgggaccucguccgccugcaagcgccggagcaacaacuccuucuucucgcgccugaacuggcucacgcaccugaaguucaaguaccccgcccugaacgugaccaugcccaacaacgagaaguucgacaagcucuacaucuggggcguccaccaccccgggaccaacaacgaccagaucucccuguacgcgcaggccucgggccggaucaccgugagcacgaagcgcucccagcagaccgugaucccgaacaucggcucgcggccccgcguccgggacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1449 - RNA, 1698 nt, Artificial Sequence
  derived and/or modified CDS sequence (AUadapt) from InfluenzaA__ABI21200__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucggccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagcggaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1450 - RNA, 1698 nt, Artificial Sequence; identical to SEQ ID NO: 1449
  derived and/or modified CDS sequence (AUadapt) from InfluenzaA__ABI21211__HA

SEQ ID NO: 1451 - RNA, 1698 nt, Artificial Sequence
  derived and/or modified CDS sequence (AUadapt) from InfluenzaA__ABI21233__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucaacuccgugucguccuucgagcgguucgagaucuucccgaaggagagcuccuggcccaaccacaccgucaccggggugagcgccuccugcagccacaacggcaaguccucguucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagcggaucgacggcgugaagcuggagucgaugggcgucuaccagauccuggccaucuacuccacgguggccagcagccucgugcugcuggucucccucggggccaucagcuucuggaugugcuccaacggcagccugcagugccgcaucugcaucuga

SEQ ID NO: 1452 - RNA, 1701 nt, Artificial Sequence
  derived and/or modified CDS sequence (AUadapt) from InfluenzaA__ABI21244__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcugaaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgucgcuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggagcggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagucgacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacaccaucgaccugacggacuccgagaugaacaagcuguucgagcgcacccgcaagcagcuccgggagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 1453 - RNA, 1701 nt, Artificial Sequence; identical to SEQ ID NO: 1298
  derived and/or modified CDS sequence (AUadapt) from InfluenzaA__ABI21255__HA

SEQ ID NO: 1454 - RNA, 1701 nt, Artificial Sequence; identical to SEQ ID NO: 1298
  derived and/or modified CDS sequence (AUadapt) from InfluenzaA__ABI21266__HA

SEQ ID NO: 1455 - RNA, 1701 nt, Artificial Sequence; identical to SEQ ID NO: 1298
  derived and/or modified CDS sequence (AUadapt) from InfluenzaA__ABI21277__HA

SEQ ID NO: 1456 - RNA, 1701 nt, Artificial Sequence
  derived and/or modified CDS sequence (AUadapt) from InfluenzaA__ABI21299__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacgacaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcggccucagcucccggaucucgaucuacuggacgaucgugaagcccggggacauccugcugaucaacuccaccggcaaccucaucgcgccccgcggguacuucaagauccggaacggcaagagcuccaucaugcgcucggacgccccgaucggcaacugcuccagcgagugcaucacccccaacggguccauccccaacgacaagcccuuccagaacgugaaccggaucaccuacggcgccugcccgcgcuacgucaagcagaacacgcugaagcuggccaccgggaugcggaacgugcccgagaagcagacccgcggcaucuucggggccaucgccggcuucaucgagaacggcugggaggggaugguggacggcugguacggguuccggcaccagaacucggagggcaccgggcaggccgccgaccucaaguccacgcaggcggccaucgaccagaucaacggcaagcugaaccgccugaucgagaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacaccaucgaccugacggacucggagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcgucgugcugcugggcuucaucaugugggccugccagaaggggaacauccggugcaacaucugcaucuga

SEQ ID NO: 1457 - RNA, 1701 nt, Artificial Sequence; identical to SEQ ID NO: 1298
  derived and/or modified CDS sequence (AUadapt) from InfluenzaA__ABI21310__HA

SEQ ID NO: 1458 - RNA, 1701 nt, Artificial Sequence
  derived and/or modified CDS sequence (AUadapt) from InfluenzaA__ABI21321__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacucggagaugaacaagcuguucgagaagacccgcaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgguuccagaucaagggcguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 1459 - RNA, 1701 nt, Artificial Sequence
  derived and/or modified CDS sequence (AUadapt) from InfluenzaA__ABI21332__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcaggccuccgggcgcgucaccgugagcaccaagcggucgcagcagaccgugaucccgaacaucggcucccgccccuggguccgggggcucagcucccgcaucucgaucuacuggacgaucgugaagcccggcgacauccugcugaucaacuccaccgggaaccucaucgcgccccggggcuacuucaagauccgcaacggcaagagcuccaucaugcggucggacgccccgaucgggaacugcuccagcgagugcaucacccccaacggcuccauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacucggaggggaccggccaggccgccgaccucaaguccacgcaggcggccaucgaccagaucaacggcaagcugaaccggcugaucgagaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugacggacucggagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgguuccagaucaagggcguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 1460 - RNA, 1701 nt, Artificial Sequence; identical to SEQ ID NO: 1298
  derived and/or modified CDS sequence (AUadapt) from InfluenzaA__ABI21343__HA

SEQ ID NO: 1461 - RNA, 1701 nt, Artificial Sequence
  derived and/or modified CDS sequence (AUadapt) from InfluenzaA__ABI21354__HA
augaagaccaucaucgcccugucguacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacaaggagugggaccuguucguggagcgcuccaaggccuacucgaacugcuaccccuacgacgugccggacuacgcgucccugcggagccucgucgccuccucgggcacgcuggaguucaucaacgaggacuucaacuggaccgggguggcccaggacggcaaguccuacgccugcaagcgcgggagcgugaacuccuucuucucgcggcugaacuggcuccacaagcuggaguacaaguaccccgcgcugaacgucaccaugcccaacaacggcaaguucgacaagcucuacaucuggggcgugcaccaccccuccaccgacagcgaccagacgucccuguacgugcgcgccucggggcgggucaccgugagcaccaagcgcucccagcagaccgugaucccgaacaucggcucgcggcccuggguccgcgggcuguccagccggaucuccaucuacuggacgaucgugaagcccggcgacauccuccugaucaacucgaccgggaaccugaucgcgccccgcggcuacuucaagauccggaacggcaaguccagcaucaugcgcuccgacgccccgaucgggaacugcucguccgagugcaucacccccaacggcagcauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagucgacgcaggcggccaucgaccagaucaacggcaagcugaaccgccugaucgagaagaccaacgagaaguuccaccagaucgagaaggaguucuccgaggucgaggggcggauccaggaccuggagaaguacguggaggacaccaagaucgaccucuggagcuacaacgccgagcugcugguggcccucgagaaccagcacaccaucgaccugacggacuccgagaugaacaagcuguucgagcgcacccgcaagcagcuccgggagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcugaaguccggcuacaaggacuggauccucuggaucagcuucgccaucagcugcuuccugcugugcgucgugcuccugggguucaucaugugggccugccagaagggcaacauccggugcaacaucugcaucuga

SEQ ID NO: 1462 - RNA, 1701 nt, Artificial Sequence
  derived and/or modified CDS sequence (AUadapt) from InfluenzaA__ABI21365__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacucggagauggacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 1463 - RNA, 1701 nt, Artificial Sequence
  derived and/or modified CDS sequence (AUadapt) from InfluenzaA__ABI21376__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacuccugcaagcgcgggagcgugaacuccuucuucagccggcucaacuggcugcacaagcuggaguacaaguaccccgcccucaacgucaccaugcccaacaacgacaaguucgacaagcuguacaucuggggcgugcaccaccccuccaccgacucggaccagacgucccuguacgugcgcgcgagcgggcgggucaccgugucgaccaagcgcucccagcagaccgugaucccgaacaucggcagccggcccuggguccgcggccucuccucgcggaucuccaucuacuggacgaucgugaagcccggggacauccugcugaucaacagcaccggcaaccucaucgcgccccgcggguacuucaagauccggaacggcaaguccagcaucaugcgcuccgacgccccgaucggcaacugcucguccgagugcaucacccccaacgggagcauccccaacgacaagcccuuccagaacgugaaccggaucaccuacggcgccugcccgcgcuacgucaagcagaacacgcugaagcuggccaccgggaugcggaacgugcccgagaagcagacccgcggcaucuucggggccaucgccggcuucaucgagaacggcugggaggggaugguggacggcugguacggguuccggcaccagaacuccgagggcaccgggcaggccgccgaccucaagucgacgcaggccgcgaucgaccagaucaacggcaagcugaaccgccugaucgagaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgccugcaucgggucgauccgcaacggcaccuacgaccacgacgucuaccgggacgaggcgcugaacaaccgcuuccagaucaaggggguggagcucaaguccggcuacaaggacuggauccuguggaucagcuucgccaucagcugcuuccugcucugcgucgugcugcugggcuucaucaugugggccugccagaaggggaacauccggugcaacaucugcaucuga

SEQ ID NO: 1464 - RNA, 1701 nt, Artificial Sequence; identical to SEQ ID NO: 1298
  derived and/or modified CDS sequence (AUadapt) from InfluenzaA__ABI21387__HA

SEQ ID NO: 1465 - RNA, 1701 nt, Artificial Sequence
  derived and/or modified CDS sequence (AUadapt) from InfluenzaA__ABI21398__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucgugaacgaggacuucaacuggaccgggguggcccaggacggcaagucguacgccugcaagcgcggguccgucaacagcuucuucucccggcucaacuggcugcacaagcuggaguacaaguaccccgcgcucaacgugaccaugcccaacaacggcaaguucgacaagcuguacaucuggggcgugcaccaccccucgaccgacuccgaccagacgagccuguacguccgcgccuccgggcgggugaccgugagcaccaagcgcucgcagcagaccgucaucccgaacaucggcucccggcccugggugcgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgucaaccggaucaccuacggggccugcccgcgcuacgugaagcagaacacgcugaagcuggccaccggcaugcggaacgugcccgagaagcagacccgcgggaucuucggcgccaucgccggcuucaucgagaacgggugggagggcauggucgacgggugguacggcuuccggcaccagaacucggaggggaccggccaggccgccgaccucaaguccacgcaggcggccaucgaccagaucaacggcaagcugaaccgccugaucgagaagaccaacgagaaguuccaccagaucgagaaggaguucagcgagguggaggggcggauccaggaccucgagaaguacguggaggacaccaagaucgaccugugguccuacaacgccgagcugcucgucgcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggugcugcugggguucaucaugugggccugccagaagggcaacauccggugcaacaucugcaucuga

SEQ ID NO: 1466 - RNA, 1701 nt, Artificial Sequence; identical to SEQ ID NO: 1298
  derived and/or modified CDS sequence (AUadapt) from InfluenzaA__ABI21409__HA

SEQ ID NO: 1467 - RNA, 1701 nt, Artificial Sequence
  derived and/or modified CDS sequence (AUadapt) from InfluenzaA__ABI21420__HA
augaagaccaucaucgcccugucguacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagagcuccucgaccgggcgcaucugcgacagcccccaccggauccuggacggcaagaacugcacgcugaucgacgcccuccugggggacccccacugcgacggcuuccagaacaaggagugggaccuguucguggagcgcuccaaggccuacuccaacugcuaccccuacgacgugccggacuacgccagccuccggucccuggucgcgucguccggcacccuggaguucaucaacgaggacuucaacuggaccgggguggcccaggacggcgggagcuacuccugcaagcgcggcucggugaacuccuucuucagccggcucaacuggcugcacaagcuggaguacaaguaccccgcccucaacgucaccaugcccaacaacgggaaguucgacaagcuguacaucuggggcgugcaccaccccuccacggacagcgaccagaccucccuguacgugcgcgccucgggccgggucaccgugagcaccaagcgcucccagcagacggugaucccgaacaucgggucgcggcccuggguccgcggccucuccagccggaucuccaucuacuggaccaucgugaagcccggggacauccugcugaucaacagcaccggcaaccucaucgcgccccgcggcuacuucaagauccggaacgggaaguccucgaucaugcgcuccgacgccccgaucggcaacugcagcuccgagugcaucacccccaacgggucgauccccaacgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgcgggguucaucgagaacggcugggaggggaugguggacggcugguacggguuccggcaccagaacuccgagggcacgggccaggccgccgaccucaagagcacccaggccgccaucgaccagaucaacgggaagcugaaccgccugaucgagaagaccaacgagaaguuccaccagaucgagaaggaguucuccgaggucgagggccggauccaggaccucgagaaguacguggaggacaccaagaucgaccuguggagcuacaacgcggagcugcucguggcccuggagaaccagcacacgaucgaccugaccgacuccgagaugaacaagcuguucgagcgcacccgcaagcagcuccgggagaacgccgaggacauggggaacggcugcuucaagaucuaccacaagugcgacaacgccugcaucgggucgauccgcaacggcaccuacgaccacgacgucuaccgggacgaggcccugaacaaccgcuuccagaucaaguccguggagcucaagagcggcuacaaggacuggauccuguggaucagcuucgcgaucuccugcuuccugcucugcgucgugcugcugggguucaucaugugggccugccagaagggcaacauccggugcaacaucugcaucuga

SEQ ID NO: 1468 - RNA, 1701 nt, Artificial Sequence; identical to SEQ ID NO: 1298
  derived and/or modified CDS sequence (AUadapt) from InfluenzaA__ABI21431__HA

SEQ ID NO: 1469 - RNA, 1701 nt, Artificial Sequence; identical to SEQ ID NO: 1298
  derived and/or modified CDS sequence (AUadapt) from InfluenzaA__ABI21442__HA

SEQ ID NO: 1470 - RNA, 1701 nt, Artificial Sequence; identical to SEQ ID NO: 1298
  derived and/or modified CDS sequence (AUadapt) from InfluenzaA__ABI21453__HA

SEQ ID NO: 1471 - RNA, 1701 nt, Artificial Sequence; identical to SEQ ID NO: 1298
  derived and/or modified CDS sequence (AUadapt) from InfluenzaA__ABI21464__HA

SEQ ID NO: 1472 - RNA, 1701 nt, Artificial Sequence; identical to SEQ ID NO: 1298
  derived and/or modified CDS sequence (AUadapt) from InfluenzaA__ABI21475__HA

SEQ ID NO: 1473 - RNA, 1701 nt, Artificial Sequence
  derived and/or modified CDS sequence (AUadapt) from InfluenzaA__ABI21486__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgucgcuccggucccuggucgccagcuccggcacgcuggaguucaucaacgaggacuucaacuggaccgggguggcccaggacggcaagucguacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccucgaccgacuccgaccagacgagccuguacgugcgcgccuccgggcgggucaccgugagcaccaagcgcucgcagcagaccgugaucccgaacaucggcucccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcucggacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacucggaggggaccggccaggccgccgaccucaaguccacgcaggaggcgaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacucggagaugaacaagcuguucgagcgcacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcgcugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 1474 - RNA, 1701 nt, Artificial Sequence; identical to SEQ ID NO: 1298
  derived and/or modified CDS sequence (AUadapt) from InfluenzaA__ABI21497__HA

SEQ ID NO: 1475 - RNA, 1698 nt, Artificial Sequence
  derived and/or modified CDS sequence (AUadapt) from InfluenzaA__ABI21530__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagucguccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccgcacggagaacgccuacgucuccguggugagcucccacuacucgcggcgcuucaccccggagaucgccaagcggcccaagguccgcgaccaggagggccggaucaacuacuacuggacccugcuggagcccggcgacaccaucaucuucgaggcgaacgggaaccucaucgcccccugguacgccuucgcccugucccgcggcuucgagagcgggaucaucacguccaacgccccgaugaacgagugcgacgcgaagugccagacgccccagggcgccaucaacagcucccugcccuuccagaacgugcaccccgugaccaucggcgagugcccgaaguacguccggagcgccaagcuccgcauggugaccgggcugcggaacauccccuccauccagagccgcggccuguucggggccaucgccggcuucaucgagggcggguggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcucgagcggcgcauggagaaccugaacaagaaggucgacgacggcuuccuggacaucuggaccuacaacgccgagcuccuggugcugcucgagaacgagcggacccuggacuuccacgacucgaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuaccccaaguacuccgaggagagcaagcugaaccgcgagaagaucgacggcgugaagcuggagagcaugggggucuaccagauccucgccaucuacuccacgguggccagcucccuggugcugcucgucagccugggcgccaucuccuucuggaugugcagcaacggcucccugcagugccggaucugcaucuga

SEQ ID NO: 1476 - RNA, 1698 nt, Artificial Sequence
  derived and/or modified CDS sequence (AUadapt) from InfluenzaA__ABI21552__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagucguccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccacacggagaacgccuacgucuccguggugagcucccacuacucgcgccgguucaccccggagaucgccaagcgccccaagguccgggaccaggagggccgcaucaacuacuacuggacccugcuggagcccggcgacaccaucaucuucgaggcgaacgggaaccucaucgcccccugguacgccuucgcccugucccggggcuucgagagcgggaucaucacguccaacgccccgauggacgagugcgacgcgaagugccagacgccccagggcgccaucaacagcucccugcccuuccagaacgugcaccccgugaccaucggcgagugcccgaaguacguccgcagcgccaagcuccggauggugaccgggcugcgcaacauccccuccauccagagccggggccuguucggggccaucgccggcuucaucgagggcggguggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcucgagcgccggauggagaaccugaacaagaaggucgacgacggcuuccuggacaucuggaccuacaacgccgagcuccuggugcugcucgagaacgagcgcacccuggacuuccacgacucgaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuaccccaaguacuccgaggagagcaagcugaaccgggagaagaucgacggcgugaagcuggagagcaugggggucuaccagauccucgccaucuacuccacgguggccagcucccuggugcugcucgucagccugggcgccaucuccuucuggaugugcagcaacggcucccugcagugccgcaucugcaucuga

SEQ ID NO: 1477 - RNA, 1698 nt, Artificial Sequence
  derived and/or modified CDS sequence (AUadapt) from InfluenzaA__ABI21563__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagucguccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccacacggagaacgccuacgucuccguggugagcucccacuacucgcgccgguucaccccggagaucgccaagcgccccaagguccggggccaggagggccgcaucaacuacuacuggacccugcuggagcccggggacaccaucaucuucgaggcgaacggcaaccucaucgcccccugguacgccuucgcccugucccggggguucgagagcggcaucaucacguccaacgccccgaugaacgagugcgacgcgaagugccagacgccccagggcgccaucaacagcucccugcccuuccagaacgugcaccccgugaccaucggggagugcccgaaguacguccgcagcgccaagcuccggauggugaccggccugcgcaacauccccuccauccagagccgggggcuguucggcgccaucgccggguucaucgagggcggcuggaccgggaugaucgacggcugguacggguaccaccaccagaacgagcagggcuccggguacgcggccgaccagaaguccacccagaacgccaucaacggcaucaccaacaaggugaacagcgucaucgagaagaugaacacccaguucacggccgugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacucgaacgugaagaaccuguacgagaaggucaagucccagcucaagaacaacgcgaaggagaucggcaacgggugcuucgaguucuaccacaagugcaacaacgagugcauggagagcgugaagaacggcaccuacgacuaccccaaguacuccgaggagagcaagcugaaccgggagaagaucgacggggugaagcuggagagcaugggcgucuaccagauccucgccaucuacuccacgguggccagcucccuggugcugcucgucagccugggcgccaucuccuucuggaugugcagcaacgggucccugcagugccgcaucugcaucuga

SEQ ID NO: 1478 - RNA, 1698 nt, Artificial Sequence; identical to SEQ ID NO: 1477
  derived and/or modified CDS sequence (AUadapt) from InfluenzaA__ABI21574__HA

SEQ ID NO: 1479 - RNA, 1701 nt, Artificial Sequence
  derived and/or modified CDS sequence (AUadapt) from InfluenzaA__ABI21736__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagccggaucuccaucuacuggacgaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacguggggaacggcugcuucaagaucuaccacaagugcgacaacgccugcaucgggagcauccgcaacggcaccuacgaccacgacgucuaccgcgacgaggcccugaacaaccgguuccagaucaaggggguggagcugaaguccggcuacaaggacuggauccucuggaucucguucgccaucagcugcuuccugcugugcgucgugcuccugggcuucaucaugugggccugccagaaggggaacauccgcugcaacaucugcaucuga

SEQ ID NO: 1480 - RNA, 1701 nt, Artificial Sequence
  derived and/or modified CDS sequence (AUadapt) from InfluenzaA__ABI22159__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaacgccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 1481 - RNA, 1707 nt, Artificial Sequence
  derived and/or modified CDS sequence (AUadapt) from InfluenzaA__ABI23979__HA
auggagaagaucgugcugcuccuggccaucaucucgcuggucaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccuccugucccggaucaaccacuucgagaagauccagaucauccccaagucguccuggagcgaccacgaggccuccucgggcguguccagcgccugcccguaccagggccgcuccucguucuuccggaacgucguguggcugaucaagaaggacaacgcguaccccaccaucaagcgcuccuacaacaacacgaaccaggaggaccugcuggugcucugggggauccaccaccccaacgacgccgccgagcagacccggcuguaccagaacccgaccaccuacaucagcgucggcacguccacccugaaccagcgccucgugcccaagaucgccacccggucgaaggugaacgggcaguccggccgcauggaguucuucuggaccauccugaagcccaacgacgcgaucaacuucgagagcaacgggaacuucaucgcccccgagaacgccuacaagaucgucaagaagggcgacucgacgaucaugaaguccgagcuggaguacggcaacugcaacaccaagugccagaccccgaucggggccaucaacagcuccaugcccuuccacaacauccacccccucaccaucggcgagugccccaaguacgucaagucgaaccggcuggugcuggccacggggcuccgcaacuccccgcagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagucgacccagaaggccaucgacggggugaccaacaaggugaacuccaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccaccggugcgacaacgagugcauggaguccguccgcaacgggaccuacgacuacccccaguacucggaggagucccgccugaagcgggaggagaucagcggcgugaagcuggaguccaucgggaccuaccagauccucucgaucuacuccacgguggccagcucccuggcccuggcgaucauggucgccggccucucgcuguggaugugcagcaacgggucccugcagugccgcaucugcaucuga

SEQ ID NO: 1482 - RNA, 1701 nt, Artificial Sequence; identical to SEQ ID NO: 527
  derived and/or modified CDS sequence (AUadapt) from InfluenzaA__ABI26646__HA

SEQ ID NO: 1483 - RNA, 1701 nt, Artificial Sequence; identical to SEQ ID NO: 1156
  derived and/or modified CDS sequence (AUadapt) from InfluenzaA__ABI30367__HA

SEQ ID NO: 1484 - RNA, 1701 nt, Artificial Sequence; identical to SEQ ID NO: 1166
  derived and/or modified CDS sequence (AUadapt) from InfluenzaA__ABI30378__HA

SEQ ID NO: 1485 - RNA, 1701 nt, Artificial Sequence; identical to SEQ ID NO: 895
  derived and/or modified CDS sequence (AUadapt) from InfluenzaA__ABI30400__HA

SEQ ID NO: 1486 - RNA, 1701 nt, Artificial Sequence
  derived and/or modified CDS sequence (AUadapt) from InfluenzaA__ABI30411__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagccggaucuccaucuacuggacgaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagauggacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggccugccagaaggggaacauccgcugcaacaucugcaucuga

SEQ ID NO: 1487 - RNA, 1701 nt, Artificial Sequence; identical to SEQ ID NO: 836
  derived and/or modified CDS sequence (AUadapt) from InfluenzaA__ABI30422__HA

SEQ ID NO: 1488 - RNA, 1701 nt, Artificial Sequence; identical to SEQ ID NO: 527
  derived and/or modified CDS sequence (AUadapt) from InfluenzaA__ABI30433__HA

SEQ ID NO: 1489 - RNA, 1701 nt, Artificial Sequence; identical to SEQ ID NO: 836
  derived and/or modified CDS sequence (AUadapt) from InfluenzaA__ABI30444__HA

SEQ ID NO: 1490 - RNA, 1701 nt, Artificial Sequence; identical to SEQ ID NO: 527
  derived and/or modified CDS sequence (AUadapt) from InfluenzaA__ABI30455__HA

SEQ ID NO: 1491 - RNA, 1701 nt, Artificial Sequence; identical to SEQ ID NO: 527
  derived and/or modified CDS sequence (AUadapt) from InfluenzaA__ABI30466__HA

SEQ ID NO: 1492 - RNA, 1701 nt, Artificial Sequence; identical to SEQ ID NO: 527
  derived and/or modified CDS sequence (AUadapt) from InfluenzaA__ABI30477__HA

SEQ ID NO: 1493 - RNA, 1701 nt, Artificial Sequence; identical to SEQ ID NO: 527
  derived and/or modified CDS sequence (AUadapt) from InfluenzaA__ABI30488__HA

SEQ ID NO: 1494 - RNA, 1701 nt, Artificial Sequence; identical to SEQ ID NO: 527
  derived and/or modified CDS sequence (AUadapt) from InfluenzaA__ABI30499__HA

SEQ ID NO: 1495 - RNA, 1701 nt, Artificial Sequence; identical to SEQ ID NO: 488
  derived and/or modified CDS sequence (AUadapt) from InfluenzaA__ABI30510__HA

SEQ ID NO: 1496 - RNA, 1701 nt, Artificial Sequence
  derived and/or modified CDS sequence (AUadapt) from InfluenzaA__ABI30521__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagagcuucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucucgcuguacgcgcaggccuccggccggaucaccgugucgacgaagcgcagccagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgccuccaucggcaagugcaacagcgagugcaucacgcccaacggguccauccccaacgacaagcccuuccagaacgugaaccgcaucaccuacggcgccugcccgcgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1497 - RNA, 1701 nt, Artificial Sequence; identical to SEQ ID NO: 527
  derived and/or modified CDS sequence (AUadapt) from InfluenzaA__ABI30532__HA

SEQ ID NO: 1498 - RNA, 1701 nt, Artificial Sequence; identical to SEQ ID NO: 1358
  derived and/or modified CDS sequence (AUadapt) from InfluenzaA__ABI30543__HA

SEQ ID NO: 1499 - RNA, 1701 nt, Artificial Sequence; identical to SEQ ID NO: 527
  derived and/or modified CDS sequence (AUadapt) from InfluenzaA__ABI30554__HA

SEQ ID NO: 1500 - RNA, 1698 nt, Artificial Sequence; identical to SEQ ID NO: 1449
  derived and/or modified CDS sequence (AUadapt) from InfluenzaA__ABI30565__HA

SEQ ID NO: 1501 - RNA, 1701 nt, Artificial Sequence; identical to SEQ ID NO: 878
  derived and/or modified CDS sequence (AUadapt) from InfluenzaA__ABI30587__HA

SEQ ID NO: 1502 - RNA, 1701 nt, Artificial Sequence
  derived and/or modified CDS sequence (AUadapt) from InfluenzaA__ABI30609__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaugaacgaccagaucgaggugaccaacgccacggagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacccuggaguucaacaacgagucguucaacuggacgggcgugacccagaacgggaccuccucggccugcaagcgccgguccaacaacagcuucuucucccgccugaacuggcucacccaccugaaguucaaguaccccgcccugaacgugacgaugcccaacaacgagaaguucgacaagcucuacaucuggggcguccaccaccccgggaccgacaacgaccagaucuuccuguacgcgcaggccucgggccggaucaccguguccaccaagcgcagccagcagacggugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacccccaacggguccauccccaacgacaagccguuccagaacgugaaccgcaucacguacggcgccugcccccgguacgucaagcagaacacccugaagcucgcgaccgggaugcgcaacgugcccgagaagcagacccggggcaucuucggggccaucgccggcuucaucgagaacggcugggaggggaugguggacggcugguacggguuccgccaccagaacucggagggcacggggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1503 - RNA, 1701 nt, Artificial Sequence
  derived and/or modified CDS sequence (AUadapt) from InfluenzaA__ABI30620__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucaucgagcgcucgaaggccuacuccaacugcuaccccuacgacgugccggacuacgcgagccugcggucccucguggccucguccgggacgcuggaguucaacaacgagagcuucaacuggaccggcgucacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucucgacgaagcgcucgcagcagaccgugaucccgaacaucggcucccggccccgcgugcgggacauccccagccgcaucuccaucuacuggaccaucgucaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagguggaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 1504 - RNA, 1701 nt, Artificial Sequence; identical to SEQ ID NO: 878
  derived and/or modified CDS sequence (AUadapt) from InfluenzaA__ABI30733__HA

SEQ ID NO: 1505 - RNA, 1701 nt, Artificial Sequence; identical to SEQ ID NO: 878
  derived and/or modified CDS sequence (AUadapt) from InfluenzaA__ABI30744__HA

SEQ ID NO: 1506 - RNA, 1701 nt, Artificial Sequence; identical to SEQ ID NO: 878
  derived and/or modified CDS sequence (AUadapt) from InfluenzaA__ABI30755__HA

SEQ ID NO: 1507 - RNA, 1701 nt, Artificial Sequence; identical to SEQ ID NO: 878
  derived and/or modified CDS sequence (AUadapt) from InfluenzaA__ABI30766__HA

SEQ ID NO: 1508 - RNA, 1701 nt, Artificial Sequence; identical to SEQ ID NO: 878
  derived and/or modified CDS sequence (AUadapt) from InfluenzaA__ABI30777__HA

SEQ ID NO: 1509 - RNA, 1701 nt, Artificial Sequence
  derived and/or modified CDS sequence (AUadapt) from InfluenzaA__ABI30788__HA
augaagaccaucaucgcccugucguacauccucugccugguguucgcccagaagcuguccggcaacgacaacucgaccgcgacgcucugccuggggcaccacgccguccccaacggcaccaucgugaagaccaucaccaacgaccagaucgaggugacgaacgccaccgagcugguccaguccagcuccaccgggggcaucugcgacucgccgcaccagauccucgacggggagaacugcacccugaucgacgcccugcucggcgacccccagugcgacggcuuccagaacaagaagugggaccuguucguggagcgcuccaaggccuacagcaacugcuaccccuacgacgugcccgacuacgcgucccugcggucgcucaucgccuccagcgggacgcuggaguucaacaacgaguccuucaacuggaccggcgucacccagaacgggaccucguccgccugcaagcgccggagcaacuccucguucuucucccgccugaacuggcucacgcaccugaaguucaaguacccggcccugaacgugaccaugcccaacaacgaggaguucgacaagcucuacaucuggggcgugcaccaccccgggaccuacaacgaccagaucagccuguacgcgcaggccucgggccggaucaccgucuccacgaagcgcagccagcagaccgugauccccaacaucggcucccggccgcgcgugcgggacauccccucgcgcaucuccaucuacuggaccaucgucaagcccggggacauccugcucaucaacagcaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 1510 - RNA, 1701 nt, Artificial Sequence; identical to SEQ ID NO: 878
  derived and/or modified CDS sequence (AUadapt) from InfluenzaA__ABI30799__HA

SEQ ID NO: 1511 - RNA, 1701 nt, Artificial Sequence
  derived and/or modified CDS sequence (AUadapt) from InfluenzaA__ABI30810__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccaucaagaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 1512 - RNA, 1701 nt, Artificial Sequence
  derived and/or modified CDS sequence (AUadapt) from InfluenzaA__ABI30821__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacguggcgaugcccaacaacgaggaguucgacaagcucuacaucuggggcgugcaccaccccgggaccuacaacgaccagaucucccuguacgcccaggccucgggccggaucaccgucucgaccaagcgcucccagcagacggugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacccccaacggguccauccccaacgacaagccguuccagaacgugaaccgcaucacguacggcgcgugcccccgguacgugaagcagaacacccugaagcucgccaccgggaugcgcaacguccccgagaagcagacccggggcaucuucggggccaucgccggcuucaucgagaacggcugggaggggaugguggacggcugguacggguuccgccaccagaacucggagggcaucgggcaggccgcggaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucacggacucggagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggcgugccagaagggcaacauccggugcaacaucugcaucuga

SEQ ID NO: 1513 - RNA, 1701 nt, Artificial Sequence; identical to SEQ ID NO: 878
  derived and/or modified CDS sequence (AUadapt) from InfluenzaA__ABI30832__HA

SEQ ID NO: 1514 - RNA, 1701 nt, Artificial Sequence
  derived and/or modified CDS sequence (AUadapt) from InfluenzaA__ABI30843__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggacccgcaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 1515 - RNA, 1701 nt, Artificial Sequence; identical to SEQ ID NO: 1458
  derived and/or modified CDS sequence (AUadapt) from InfluenzaA__ABI30865__HA

SEQ ID NO: 1516 - RNA, 1707 nt, Artificial Sequence
  derived and/or modified CDS sequence (AUadapt) from InfluenzaA__ABI36155__HA
auggagaagaucgugcugcuccuggccaccgucucgcuggugaaguccgaccagaucugcaucggcuaccacgccaacaacucgaccgagcaggucgacacgaucauggagaagaacgugaccgugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgggcugugcuaccccggcaacuucaacgacuacgaggagcugaagcaccuccugucccggaucaaccacuucgagaagcugcagaucauccccaagucguccuggagcgaccacgaggccucccucggcgucucguccgcgugcccguaccuggggcgcagcuccuucuuccggaacgugguguggcugaucaagaagaacaacacguaccccaccaucaagcgcucguacaacaacaccaaccaggaggaccuccugguccuguggggcauccaccaccccaacgacgccgccgagcagacccggcucuaccagaacccgacgaccuacaucuccguggggaccagcacccugaaccagcgccuggugcccaagaucgccacgcgguccaaggucaacggccagucggggcgcauggaguucuucuggaccauccucaagcccaacgacgcgaucaacuucgaguccaacggcaacuucaucgcccccgaguacgccuacaagaucgugaagaagggcgacagcgccaucaugaaguccgagcuggaguacggggacugcaacaccaagugccagaccccgaugggcgccaucaacucgucgaugccccugcacaacauccacccccucacgaucggggagugccccaaguacgugaaguccaaccggcugguccuggcgaccggccuccgcaacagcccgcagcgggagcgccggcgcaagaagcggggccuguucggggccaucgccggcuucaucgagggcggguggcaggggaugguggacggcugguacggcuaccaccacuccaacgagcaggggucgggcuacgccgccgacaaggaguccacccagaaggcgaucgacggggugaccaacaaggucaacagcaucaucgacaagaugaacacgcaguucgaggccgugggccgcgaguucaacaaccuggagcggcgcaucgagaaccucaacaagaagauggaggacggguuccuggacguguggaccuacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccacaagugcgacaacgagugcauggagucgauccgcaacgggaccuacaacuacccccaguacuccgaggaggcccgccugaagcgggaggagaucagcggcgugaagcuggaguccaucgggaucuaccagauccucucgaucuacuccacgguggcgagcucccuggcccuggccaucaugauggccggccucucgcuguggaugugcuccaacgggagccugcagugccgcgucugcaucuga

SEQ ID NO: 1517 - RNA, 1707 nt, Artificial Sequence
  derived and/or modified CDS sequence (AUadapt) from InfluenzaA__ABI36166__HA
auggagaagaucgugcugcuccuggccaccgucucgcuggugaaguccgaccagaucugcaucggcuaccacgccaacaacagcaccgagcaggucgacacgaucauggagaagaacgugaccgugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgggcugugcuaccccggcaacuucaacgacuacgaggagcugaagcaccuccugucccggaucaaccacuucgagaagcugcagaucauccccaagagcuccuggucggaccacgaggccucccucggcgucagcuccgcgugcccguaccuggggcgcucguccuucuuccggaacgugguguggcugaucaagaagaacaacacguaccccaccaucaagcgcagcuacaacaacaccaaccaggaggaccuccugguccuguggggcauccaccaccccaacgacgccgccgagcagacccggcucuaccagaacccgacgaccuacaucuccguggggaccucgacccugaaccagcgccuggugcccaagaucgccacgcgguccaaggucaacggccagagcgggcgcauggaguucuucuggaccauccucaagcccaacgacgcgaucaacuucgaguccaacggcaacuucaucgcccccgaguacgccuacaagaucgugaagaagggcgacucggccaucaugaaguccgagcuggaguacggggacugcaacaccaagugccagaccccgaugggcgccaucaacagcucgaugcccuuccacaacauccacccccugacgaucggggagugccccaaguacgugaaguccaaccggcucguccuggcgaccggccugcgcaacagcccgcagcgggagcgccggcgcaagaagcggggccucuucggggccaucgccggcuucaucgagggcggguggcaggggaugguggacggcugguacggcuaccaccacuccaacgagcaggggucgggcuacgccgccgacaaggaguccacccagaaggcgaucgacggggugaccaacaaggucaacagcaucaucgacaagaugaacacgcaguucgaggccgugggccgcgaguucaacaaccuggagcggcgcaucgagaaccugaacaagaagauggaggacggguuccucgacguguggaccuacaacgccgagcugcugguccucauggagaacgagcggacccuggacuuccacgacuccaacgugaagaaccuguacgacaagguccgccuccagcugcgggacaacgccaaggagcugggcaacggcugcuucgaguucuaccacaagugcgacaacgagugcauggagucgauccgcaacgggaccuacaacuacccccaguacuccgaggaggcccgccucaagcgggaggagaucagcggcgugaagcuggaguccaucgggaucuaccagauccugucgaucuacuccacgguggcgagcucccucgcccuggccaucaugauggccggccugucgcucuggaugugcuccaacgggagccugcagugccgcgucugcaucuga

SEQ ID NO: 1518 - RNA, 1707 nt, Artificial Sequence; identical to SEQ ID NO: 1517
  derived and/or modified CDS sequence (AUadapt) from InfluenzaA__ABI36177__HA

SEQ ID NO: 1519 - RNA, 1707 nt, Artificial Sequence
  derived and/or modified CDS sequence (AUadapt) from InfluenzaA__ABI36406__HA
auggagaagaucgugcugcuccuggccaccgucucgcuggugaaguccgaccagaucugcaucggcuaccacgccaacaacagcaccgagcaggucgacacgaucauggagaagaacgugaccgugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgggcugugcuaccccggcaacuucaacgacuacgaggagcugaagcaccuccugucccggaucaaccacuucgagaagcugcagaucauccccaagagcuccuggucggaccacgaggccucccucggcgucagcuccgcgugcccguaccuggggcgcucguccuucuuccggaacgugguguggcugaucaagaagaacaacacguaccccaccaucaagcgcagcuacaacaacaccaaccaggaggaccuccugguccuguggggccuccaccaccccaacgacgccgccgagcagacccggcuguaccagaacccgacgaccuacaucuccguggggaccucgacccugaaccagcgccucgugcccaagaucgccacgcgguccaaggucaacggccagagcgggcgcauggaguucuucuggaccauccugaagcccaacgacgcgaucaacuucgaguccaacggcaacuucaucgcccccgaguacgccuacaagaucgugaagaagggcgacucggccaucaugaaguccgagcuggaguacggggacugcaacaccaagugccagaccccgaugggcgccaucaacagcucgaugcccuuccacaacauccacccccucacgaucggggagugccccaaguacgugaaguccaaccggcugguccuggcgaccggccuccgcaacagcccgcagcgggagcgccggcgcaagaagcggggccuguucggggccaucgccggcuucaucgagggcggguggcaggggaugguggacggcugguacggcuaccaccacuccaacgagcaggggucgggcuacgccgccgacaaggaguccacccagaaggcgaucgacggggugaccaacaaggucaacagcaucaucgacaagaugaacacgcaguucgaggccgugggccgcgaguucaacaaccuggagcggcgcaucgagaaccucaacaagaagauggaggacggguuccuggacguguggaccuacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccacaagugcgacaacgagugcauggagucgauccgcaacgggaccuacaacuacccccaguacuccgaggaggcccgccugaagcgggaggagaucagcggcgugaagcuggaguccaucgggaucuaccagauccucucgaucuacuccacgguggcgagcucccuggcccuggccaucaugauggccggccucucgcuguggaugugcuccaacgggagccugcagugccgcgucugcaucuga

SEQ ID NO: 1520 - RNA, 1707 nt, Artificial Sequence
  derived and/or modified CDS sequence (AUadapt) from InfluenzaA__ABI36450__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgggaagacccacaacggcaagcugugcgaccuggacggggugaagccccucauccugcgcgacugcuccgucgccggcuggcugcucgggaacccgaugugcgacgaguucaucaacgugcccgaguggucguacaucguggagaaggccaaccccaccaacgaccugugcuaccccggcuccuucaacgacuacgaggagcugaagcaccuccugagccggaucaaccacuucgagaagauccagaucaucccgaaguccagcugguccgaccacgaggccucguccggcgucagcuccgccugccccuaccuggggucgcccuccuucuuccgcaacgugguguggcucaucaagaagaacagcacguaccccaccaucaagaccuccuacaacaacaccaaccaggaggaccugcugguccucuggggcauccaccacagcaacgacgcggccgagcagacgcggcuguaccagaacccgaccaccuacaucuccaucgggaccucgacgcugaaccagcgccucgugcccaagaucgccacccggagcaaggugaacggccaguccgggcgcauggaguucuucuggaccauccugaagcccaacgacgccaucaacuucgagucgaacggcaacuucaucgcgcccgaguacgccuacaagaucgucaagaagggcgacuccgccaucaugaaguccgagcuggaguacgggaacugcaacaccaagugccagacgccgaugggcgccaucaacagcagcaugcccuuccacaacauccacccccucaccaucggggagugccccaaguacgugaaguccaaccggcuggugcuggccaccggccuccgcaacucgccgcagcgggagucccgccggaagaagcgcggccuguucggggcgaucgccggcuucaucgagggcggguggcaggggauggucgacggcugguacggcuaccaccacagcaacgagcagggguccggcuacgccgccgacaaggagucgacccagaaggccaucgacggggugacgaacaaggugaacuccaucaucgacaagaugaacacccaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccacaagugcgacaacgagugcauggaguccauccggaacgggacguacaacuacccccaguacagcgaggaggcccgccugaagcgggaggagaucuccggcgucaagcuggagucgaucgggaccuaccagauccucuccaucuacagcaccguggccucgucccuggcgcuggccaucaugaucgccggccucagccuguggaugugcuccaacgggagccugcagugccgcaucugcaucuga

SEQ ID NO: 1521 - RNA, 1707 nt, Artificial Sequence
  derived and/or modified CDS sequence (AUadapt) from InfluenzaA__ABI49396__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgggaagacccacaacggcaagcugugcgaccuggacggggugaagccccucauccugcgcgacugcuccgucgccggcuggcugcucgggaacccgaugugcgacgaguucaucaacgugcccgaguggucguacaucguggagaaggccaaccccaccaacgaccugugcuaccccggcuccuucaacgacuacgaggagcugaagcaccuccugagccggaucaaccacuucgagaagauccagaucaucccgaaguccucgugguccgaccacgaggccagcuccggcgucagcuccgccugccccuaccuggggucgcccuccuucuuccgcaacgugguguggcucaucaagaagaacagcacguaccccaccaucaagaaguccuacaacaacaccaaccaggaggaccugcugguccucuggggcauccaccacccgaacgacgcggccgagcagacccggcuguaccagaaccccacgaccuacaucucgaucgggaccuccacccugaaccagcgccucgugcccaagaucgccacgcggagcaaggugaacggccagagcgggcgcauggaguucuucugggccauccugaagcccaacgacgcgaucaacuucgaguccaacggcaacuucaucgccccggaguacgccuacaagaucgucaagaagggcgacucggccaucaugaaguccgagcuggaguacgggaacugcaacaccaagugccagacccccaugggcgccaucaacagcuccaugcccuuccacaacauccacccccucaccaucggggagugcccgaaguacgugaaguccaaccggcuggugcuggcgacgggccuccgcaacucgccccagcgggagagccgccggaagaagcgcggccuguucggggccaucgccggcuucaucgagggcggguggcaggggauggucgacggcugguacggcuaccaccacuccaacgagcaggggucgggcuacgccgccgacaaggaguccacccagaaggcgaucgacggggugaccaacaaggugaacagcaucaucgacaagaugaacacccaguucgaggccgucggccgggaguucaacaaccuggagcgccggaucgagaaccucaacaagaagauggaggacggguuccuggacguguggacguacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccacaagugcgacaacgagugcauggagagcauccggaacgggaccuacaacuacccccaguacuccgaggaggcccgccugaagcgggaggagaucucgggcgucaagcuggaguccaucgggaccuaccagauccucagcaucuacuccacgguggcgucgagccuggcccuggccaucaugaucgccggccucucccuguggaugugcagcaacgggucccugcagugccgcaucugcaucuga

SEQ ID NO: 1522 - RNA, 1704 nt, Artificial Sequence
  derived and/or modified CDS sequence (AUadapt) from InfluenzaA__ABI85000__HA
augaauacccagauccuggccuucaucgccugcaugcucaucggcaccaagggggacaagaucugccugggccaccacgcgguggccaacgggacgaaggucaacacccugaccgagcgcggcaucgagguggugaaugccaccgagacggucgagaccgugaacaucaagaagaucugcacccaggggaagcggcccaccgaccucggccagugcggccugcuggggacgcucaucggcccgccccagugcgaccaguuccuggaguucgaugccaaccugaucaucgagcgccgggaggggaccgacgugugcuaccccggcaaguucaccaacgaggagagccuccgccagauccugcggggguccggcggcaucgacaaggagaguaugggguucaccuacuccggcauccgcacgaacggggccaccagcgcgugccggcgcuccggcagcuccuucuacgccgagaugaaguggcugcucaguaacuccgacaacgccgccuucccccagaugaccaagagcuaccggaacccgcgcaacaagcccgcgcugaucaucuggggcguccaucacuccgggagcgccaccgagcagacgaagcuguacggcuccgggaacaagcucaucaccgugggcagcuccaaguaccagcagagcuucacccccucccccggggcccggccccaggugaauggccagagcggccgcaucgacuuccacuggcugcugcucgacccgaacgacaccgucacguucaccuuuaacggggccuucaucgcccccgaccgggcguccuucuuccgcggcgagagccugggggugcagagcgacgugccccuggauuccggcugcgagggggacugcuuccacagcggcggcaccaucgucuccagccucccguuccagaauaucaacccccggaccguggggaagugcccccgcuacgugaagcagacgucccugcugcucgccaccggcaugcggaacguccccgagaacccgaagcaggccuaccagaagcgcaugacccgggggcuguucggcgccaucgccggguucaucgagaauggcugggagggccugaucgacgggugguacggcuuccgccaccagaacgcgcagggggagggcaccgccgccgacuacaagagcacgcaguccgccaucgaucagaucaccggcaagcucaaccggcugaucgacaagaccaaccagcaguucgagcugaucgacaacgaguucagcgagaucgagcagcagaucgggaaugugaucaacuggacccgcgacuccaugacggagguguggagcuacaacgccgagcuccuggucgcgauggagaaccagcacaccaucgaccuggccgauuccgagaugaacaagcucuacgagcgcgugcggaagcagcugcgcgagaacgccgaggaggacggcaccgggugcuucgagaucuuccacaagugugacgaccagugcauggagagcauccggaacaacaccuacgaccauacgcaguaccgcaccgagucccugcagaaccggauccagaucgaccccgugaagcucagcuccggcuacaaggacaucauccugugguucagcuuuggggccuccugcuuccugcuccuggccaucgcgaugggccuggucuucaucugcaucaagaacggcaacaugcgcugcaccaucugcaucuga

SEQ ID NO: 1523 - RNA, 1701 nt, Artificial Sequence; identical to SEQ ID NO: 1075
  derived and/or modified CDS sequence (AUadapt) from InfluenzaA__ABI92291__HA

SEQ ID NO: 1524 - RNA, 1701 nt, Artificial Sequence
  derived and/or modified CDS sequence (AUadapt) from InfluenzaA__ABI92302__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagucguccuggccgaagcacaacgucacccgcggggugacggccagcugcucccacaagggcaagagcuccuucuaccggaaccuccuguggcugaccgagaagaacgggagcuaccccaaccucucgaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucagccggggguucggcuccgggaucaucaccucgaacgcguccauggacgagugcgacgccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagagccggggccuguucggggccaucgccggcuucaucgagggcggcuggaccggcaugaucgacgggugguacggcuaccaccaccagaacgagcagggguccggcuacgcggccgaccagaaguccacgcagaacgccaucaacgggaucaccaacaaggugaacucggucaucgagaagaugaacauccaguucaccgccgugggcaaggaguucaacaagcuggagaagcgcauggagaaccucaacaagaagguggacgacggcuuccuggacaucuggaccuacaacgccgagcugcucguccugcuggagaacgagcggacgcucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuacccgaaguacagcgaggaguccaagcucaaccgcgagaagaucgacggcgugaagcuggagucgaugggggucuaccagauccuggccaucuacuccaccguggccagcucccucgugcugcuggucagccucggcgccaucuccuucuggaugugcagcaacggcucccugcagugccggaucugcaucuga

SEQ ID NO: 1525 - RNA, 1701 nt, Artificial Sequence
  derived and/or modified CDS sequence (AUadapt) from InfluenzaA__ABI92313__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccaucagcuccuucgagcgcuucgagaucuucccgaaggagucguccuggcccaaccacaccgucaccaagggggugaccgccagcugcucccacaacggcaagagcuccuucuacaagaaccugcucuggcugacggagaagaacgggcuguaccccaaccucucgaaguccuacgugaacaacaaggagaaggagguccuggugcuguggggcgugcaccaccccagcaacaucggggaccagcgggccaucuaccacaccgagaacgcguacgucagcgugguguccagccacuacucccgccgguucaccccggagaucaccaagcgccccaagguccgggaccaggagggccgcaucaacuacuacuggacgcuccuggagcccggcgacaccaucaucuucgaggccaacgggaaccugaucgcccccugguacgccuucgcccucucgcggggcuucggguccggcaucaucaccagcaacgcguccaugggcgagugcgacgccaagugccagaccccgcagggggccaucaacagcucccugcccuuccagaacgugcaccccgugacgaucggcgagugccccaaguacguccgcucgaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacgcagaacgccaucgacggcaucaccaacaaggugaacagcgucaucgagaagaugaacacccaguucaccgccguggggaaggaguucaacaagcuggagcgccggauggagaaccucaacaagaagguggacgacggcuuccuggacaucuggacguacaacgccgagcugcucguccugcuggagaacgagcgcacccucgacuuccacgacucgaacgugaagaaccuguacgagaaggucaagaaccagcugaagaacaacgcgaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgugaagcuggagagcaugggcgucuaccacauccuggccaucuacucgaccguggccuccagccucgugcugcuggucucccucggggccaucagcuucuggaugugcuccaacggcagccugcagugccgcaucugcaucuga

SEQ ID NO: 1526 - RNA, 1701 nt, Artificial Sequence
  derived and/or modified CDS sequence (AUadapt) from InfluenzaA__ABI92324__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacgccugcaagcgcggguccgugaacucguucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggaaggucaccgugucgaccaagcggagccagcagaccgugaucccgaacaucggcuuccgccccuggguccgggggcucuccagccgcaucuccaucuacuggacgaucgugaagcccggcgacauccugcugaucaacucgaccgggaaccucaucgcgccccggggcuacuucaagauccgcaacggcaaguccagcaucaugcgguccgacgccccgaucgggaacugcucguccgagugcaucacccccaacggcagcauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggucguacaacgccggccugcucguggcccuggagaaccagcacaccaucgaccugacggacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcucaaguccggguacaaggacuggauccuguggaucagcuucgccaucuccugcuuccugcucugcgucgugcugcugggcuucaucaugugggccugccagaaggggaacauccgcugcaacaucugcaucuga

SEQ ID NO: 1527 - RNA, 1701 nt, Artificial Sequence
  derived and/or modified CDS sequence (AUadapt) from InfluenzaA__ABI92335__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgcuguacgcgcaggccagcggccgcgugaccgucuccaccaagcggucgcagcagaccgugaucccgaacaucgggucccgccccugggugcggggcgucagcucccgcaucucgaucuacuggacgaucgugaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacucggaggggaccggccaggccgccgaccugaaguccacgcaggcggccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgccgaggacaugggcaacgggugcuucaagaucuaccacaagugcgacaacgcgugcaugggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcaucgugcucaugggcuucaucaugugggccugccagaagggcaacauccggugcaacaucugcaucuga

SEQ ID NO: 1528 - RNA, 1701 nt, Artificial Sequence
  derived and/or modified CDS sequence (AUadapt) from InfluenzaA__ABI92346__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccacaucaagggggucgagcugaaguccggcuacaaggacugggugcucuggaucucguucgccaucagcugcuuccugcugugcaucguccuccugggcuucaucaugugggccugccagaaggggaacauccggugcaacaucugcaucuga

SEQ ID NO: 1529 - RNA, 1701 nt, Artificial Sequence; identical to SEQ ID NO: 527
  derived and/or modified CDS sequence (AUadapt) from InfluenzaA__ABI92357__HA

SEQ ID NO: 1530 - RNA, 1701 nt, Artificial Sequence; identical to SEQ ID NO: 527
  derived and/or modified CDS sequence (AUadapt) from InfluenzaA__ABI92368__HA

SEQ ID NO: 1531 - RNA, 1698 nt, Artificial Sequence; identical to SEQ ID NO: 1449
  derived and/or modified CDS sequence (AUadapt) from InfluenzaA__ABI92379__HA

SEQ ID NO: 1532 - RNA, 1701 nt, Artificial Sequence
  derived and/or modified CDS sequence (AUadapt) from InfluenzaA__ABI92390__HA
augaagaccaucaucgccuucucguacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccucgaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccuggucgccucguccgggacgcucgaguucaacaacgagagcuucaacuggaccggcgugacccagaacgggaccuccucggccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaccucgcucuacgcgcaggccuccggccggaucacggugagcaccaagcgcucgcagcagaccgugaccccgaacaucggcucccggccccgcguccgggacauccccucgcgcaucuccaucuacuggacgaucgugaagcccggggacauccugcugaucaacagcaccggcaaccucaucgccccgcggggguacuucaagauccgcuccggcaagucguccaucaugcggucggacgcccccaucggcaagugcaacuccgagugcaucacccccaacgggucgauccccaacgacaagccguuccagaacgugaaccgcaucaccuacggcgccugcccccgguacgucaagcagaacacgcugaagcuggcgaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacgcaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggucguacaacgccgagcugcucguggcccuggagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 1533 - RNA, 1701 nt, Artificial Sequence; identical to SEQ ID NO: 527
  derived and/or modified CDS sequence (AUadapt) from InfluenzaA__ABI92401__HA

SEQ ID NO: 1534 - RNA, 1701 nt, Artificial Sequence
  derived and/or modified CDS sequence (AUadapt) from InfluenzaA__ABI92412__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccagugcgacggcuuccagaacaagaagugggaccuguucguggagcgcagcaaggccuacuccaacugcuaccccuacgacgugccggacuacgcgucgcuccggucccugaucgccagcuccgggacgcuggaguucaacaacgagucguucaacuggaccggcgucacccagaacgggaccuccagcgccugcaagcgccgguccaacucguccuucuucagccgccucaacuggcugacgcaccugaaguucaaguaccccgcccucaacgugaccaugcccaacaacgaggaguucgacaagcuguacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccuccugaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacaucaaccgcaucaccuacggcgccugcccccgguacgugaagcagaacacccucaagcuggcgaccgggaugcgcaacgugcccgagaagcagacgcggggcaucuucggggccaucgccggcuucaucgagaacggcugggaggggauggucgacggcugguacggguuccgccaccagaacucggagggcaucgggcaggccgccgaccugaaguccacccaggcggccaucgaccagaucaacggcaagcucaaccggcugaucggcaagaccaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacacgaucgaccugaccgacucggagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcguggagcugaaguccggcuacaaggacuggauccucuggaucuccuucgccaucagcugcuuccugcugugcgucgcccuccugggguucaucaugugggccugccagaagggcaacauccggugcaacaucugcaucuga

SEQ ID NO: 1535 - RNA, 1701 nt, Artificial Sequence
  derived and/or modified CDS sequence (AUadapt) from InfluenzaA__ABI92423__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgacaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1536 - RNA, 1701 nt, Artificial Sequence; identical to SEQ ID NO: 878
  derived and/or modified CDS sequence (AUadapt) from InfluenzaA__ABI92434__HA

SEQ ID NO: 1537 - RNA, 1701 nt, Artificial Sequence
  derived and/or modified CDS sequence (AUadapt) from InfluenzaA__ABI92445__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgccucgcugcggucccucaucgcgagcuccgggacccuggaguucaacaacgagucguucaacuggaccggcgucaaccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcccaggcgucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgccaccgggaugcgcaacguccccgagaagcagacgcggggcaucuucggggcgaucgccggcuucaucgagaacggcugggaggggaugguggacggcugguacggguuccgccaccagaacucggagggcaucgggcaggccgccgaccugaaguccacccaggccgcgaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacacgugcaucggcuccauccgcaacgggaccuacgaccacgacguguaccgggacgaggcccucaacaaccgcuuccagaucaagggcgucgagcugaaguccggcuacaaggacuggauccuguggaucuccuucgcgaucagcugcuuccuccugugcguggcccugcucggguucaucaugugggccugccagaagggcaacauccggugcaacaucugcaucuga

SEQ ID NO: 1538 - RNA, 1701 nt, Artificial Sequence; identical to SEQ ID NO: 878
  derived and/or modified CDS sequence (AUadapt) from InfluenzaA__ABI92456__HA

SEQ ID NO: 1539 - RNA, 1701 nt, Artificial Sequence; identical to SEQ ID NO: 1486
  derived and/or modified CDS sequence (AUadapt) from InfluenzaA__ABI92467__HA

SEQ ID NO: 1540 - RNA, 1701 nt, Artificial Sequence; identical to SEQ ID NO: 895
  derived and/or modified CDS sequence (AUadapt) from InfluenzaA__ABI92478__HA

SEQ ID NO: 1541 - RNA, 1701 nt, Artificial Sequence; identical to SEQ ID NO: 1486
  derived and/or modified CDS sequence (AUadapt) from InfluenzaA__ABI92489__HA

SEQ ID NO: 1542 - RNA, 1701 nt, Artificial Sequence
  derived and/or modified CDS sequence (AUadapt) from InfluenzaA__ABI92500__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccccggggcgggugaccgugucgaccaagcgcucccagcagaccgucauccccaacaucggcagccggcccugggugcgcggcguguccucgcggaucuccaucuacuggacgaucgucaagcccggggacauccuccugaucaacugcaccggcaaccugaucgccccgcgcggguacuucaagauccggagcggcaaguccucgaucaugcgcuccgacgccagcaucggcaagugcaacuccgagugcaucacccccaacgggucgauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgugaucaaccagaucaacggcaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggcuucaucaugugggccugccagaaggggaacauccgcugcaacaucugcaucuga

SEQ ID NO: 1543 - RNA, 1701 nt, Artificial Sequence
  derived and/or modified CDS sequence (AUadapt) from InfluenzaA__ABI92511__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggaucaucugcgacucgccccaccagauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggucgcuggucgccuccagcggcacgcuggaguucaacaacgaguccuucaacuggaccgggguggcccagaacggcaccucguccgccugcaagcgccggagcgacaaguccuucuucucgcgccucaacuggcugcaccagcugaaguacaaguaccccgcgcucaacgugaccaugcccaacacggagaaguucgacaagcuguacaucuggggcguccaccaccccuccaccgacagcgaccagaucucccuguacgcccaggccucggggcgggugaccgugagcaccaagcgcucccagcagacggucaucccgaacaucgggucgcggcccugggugcgcggcguguccagccgggucuccaucuacuggaccaucgugaagcccggcgacauccuccugaucaacucgaccgggaaccugaucgcgccccgcggcuacuucaagauccgguccggcaagagcuccaucaugcgcucggacgccuccaucgggaagugcaacagcaagugcaucaccccgaacggcuccauccccaacgacaagcccuuccagaacgugaaccggaucacguacggggccugcccccgcuacgucaagcagaacacccucaagcuggccaccggcaugcggaacgugccggagaagcagacccgcgggaucuucggcgccaucgccggguucaucgagaacggcugggagggcaugguggacgggugguacggcuuccggcaccagaacucggaggggacgggccaggccgcggaccugaaguccacccaggccgccaucaaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacucggagaugaacaagcuguucgagcgcaccaagaagcagcuccgggagaacgcggaggacaugggcaacgggugcuucaagaucuaccacaagugcgacaacacgugcaucggcuccauccgcaacgggaccuacgaccacgacgucuaccgcgacgaggcccugaacaaccgguuccagaucaagggcguggagcucaagagcggguacaaggacuggauccuguggaucagcuucgccaucuccugcuuccugcugugcgucgugcuccugggcuucaucaugugggccugccagaagggcaacauccgcugcaacaucugcaucuga

SEQ ID NO: 1544 - RNA, 1701 nt, Artificial Sequence
  derived and/or modified CDS sequence (AUadapt) from InfluenzaA__ABI92522__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugaaguccgacgccccgaucggcaagugcaacuccgagugcaucacccccaacgggucgauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccucaagagcacgcaggcggccaucaaccagaucaacggcaagcugaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcaucgugcuccugggcuucaucaugugggccugccagaaggggaacauccgcugcaacaucugcaucuga

SEQ ID NO: 1545 - RNA, 1701 nt, Artificial Sequence
  derived and/or modified CDS sequence (AUadapt) from InfluenzaA__ABI92533__HA
augaagaccaucaucgcccugucguacauccucugccugguguucgcccagaagcugcccggcaacgacaacucccgcgcgacccucugccuggggcaccacgccgucccgaacggcacgcuggugaagaccaucaccaacgaccagaucgaggugaccaacgccacggagcucguccagucguccagcaccgggcggaucugcgacucgccccaccagauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgucucgcuccggucccugguggcgagcuccggcacccuggaguucaacaacgagucguucaacuggacggggguggcccagaacggcaccuccagcgccugcaagcgccgguccgacaagucguucuucucccgccucaacuggcugcaccagcugaaguacaaguaccccgcccucaacgucaccaugcccaacaacgagaaguucgacaagcuguacaucuggggcgugcaccaccccgggaccgacagcgaccagaucucccuguacgcgcaggccucggggcgggugacggucagcaccaagcgcucccagcagaccgugaucccgaacaucggcucgcggcccugggugcgcggcgucuccagccggaucuccaucuacuggaccaucgugaagcccggggacauccuccugaucaacucgacgggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcccgugcccccgcuacgucaagcagaacacccucaagcuggccacggggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacccaggccgcgaucaaccagaucaacggcaagcucaaccgccugaucgagaagacgaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugaccgacuccgagaugaacaagcuguucgagcgcacgaagaagcagcuccgcgagaacgccgaggacauggggaacggcugcuucaagaucuaccacaagugcgacaacgccugcaucgggagcauccggaacggcaccuacgaccacgacguguaccgcgacgaggcgcugaacaaccgguuccagaucaagggggucgagcugaaguccggcuacaaggacuggauccucuggaucucguucgccaucagcugcuuccugcugugcaucgugcuccugggcuucaucaugugggccugccagaaggggaacauccgcugcaacaucugcaucuga

SEQ ID NO: 1546 - RNA, 1701 nt, Artificial Sequence; identical to SEQ ID NO: 1545
  derived and/or modified CDS sequence (AUadapt) from InfluenzaA__ABI92544__HA

SEQ ID NO: 1547 - RNA, 1701 nt, Artificial Sequence
  derived and/or modified CDS sequence (AUadapt) from InfluenzaA__ABI92577__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucucgcuccggucccugguggcgagcuccggcacgcuggaguucaacaacgagucguucaacuggaccgggguggcccagaacggcaccuccagcgccugcaagcgccgguccgacaagucguucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgggugaccgucagcaccaagcgcucccagcagaccgugaucccgaacaucggcucgcggcccugggugcgcggcgucuccagcaagaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucucguucgccaucagcugcuuccugcugugcaucgugcuccugggcuucaucaugugggccugccagaaggggaacauccggugcaacaucugcaucuga

SEQ ID NO: 1548 - RNA, 1701 nt, Artificial Sequence; identical to SEQ ID NO: 1284
  derived and/or modified CDS sequence (AUadapt) from InfluenzaA__ABI92588__HA

SEQ ID NO: 1549 - RNA, 1701 nt, Artificial Sequence
  derived and/or modified CDS sequence (AUadapt) from InfluenzaA__ABI92599__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcaacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaagacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucucguucgccaucagcugcuuccugcugugcaucgugcuccugggcuucaucaugugggccugccagaaggggaacauccggugcaacaucugcaucuga

SEQ ID NO: 1550 - RNA, 1701 nt, Artificial Sequence
  derived and/or modified CDS sequence (AUadapt) from InfluenzaA__ABI92610__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucucguucgccaucagcugcuuccugcugugcaucgugcuccugggcuucaucaugugggccugccagaaggggaacauccggugcaacaucugcaucuga

SEQ ID NO: 1551 - RNA, 1701 nt, Artificial Sequence
  derived and/or modified CDS sequence (AUadapt) from InfluenzaA__ABI92621__HA
augaagaccaucaucgcccugucguacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccucgaccgggcgcaucugcaacagcccccaccagauccuggacggcgagaacugcacccugaucgacgcccuccugggggacccccacugcgagggcuuccagaacaaggagugggaccuguucguggagcgguccaaggccuacuccaacugcuaccccuacgacgugccggacuacgucucgcuccgcucccugguggcgagcuccggcacccuggaguucaacaacgagucguucaacuggacggggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggaccgacucggaccagaucucccuguacgcgcaggccagcgggcgcgugacggucucgaccaagcggucccagcagaccgugaucccgaacaucggcagccgccccugggugcggggcgucuccucgaagaucuccaucuacuggaccaucgugaagcccggggacauccuccugaucaacagcacgggcaaccugaucgcgccccgcggguacuucaagauccgguccggcaagagcuccaucaugcgcucggacgccccgaucgacaagugcaacuccgagugcaucacccccaacggcagcauccccaacgacaagcccuuccagaacgugaaccggaucaccuacgggcucugcccgcgcuacgucaagcagaacacccugaagcuggccacgggcaugcggaacgugcccgagaagcagacccgcgggaucuucggcgccaucgccggguucaucgagaacggcugggagggcaugauggacgggugguacggcuuccggcaccagaacuccgaggggaccggccaggccgccgaccucaagucgacccaggccgcgaucaaccagaucaacgggaagcugaaccgccugaucgagaagacgaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugaccgacuccgagaugaacaagcuguucgagcgcacgaagaagcagcuccgggagaacgccgaggacaugggcaacgggugcuucaagaucuaccacaagugcgacaacgccugcaucggcucgauccgcaacgggaccuacgaccacgacguguaccgcgacgaggcgcugaacaaccgguuccagaucaagggcgucgagcucaaguccggguacaaggacuggauccuguggaucagcuucgccaucagcugcuuccugcucugcaucgugcugcugggcuucaucaugugggccugccagaagggcaacauccgcugcaacaucugcaucuga

SEQ ID NO: 1552 - RNA, 1701 nt, Artificial Sequence; identical to SEQ ID NO: 807
  derived and/or modified CDS sequence (AUadapt) from InfluenzaA__ABI92632__HA

SEQ ID NO: 1553 - RNA, 1701 nt, Artificial Sequence
  derived and/or modified CDS sequence (AUadapt) from InfluenzaA__ABI92643__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccauccccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagcgccagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggccugccagaagggcaacauccgcugcaacaucugcaucuga

SEQ ID NO: 1554 - RNA, 1701 nt, Artificial Sequence
  derived and/or modified CDS sequence (AUadapt) from InfluenzaA__ABI92665__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgcggcuccaacaagucguucuucucccggcugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccgcaucaccgugucgacgaagcggucccagcagaccgugaucccgaacaucgggucgcgcccccggguccgcgacguguccagccggaucuccaucuacuggaccaucgugaagcccggcgacauccugcucaucaacucgaccgggaaccugaucgcgccccgcggcuacuucaagauccgguccggcaagucguccaucaugcgcagcgacgccccgaucgggaagugcaacuccgagugcaucacgcccaacggcucgauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggcuucaucgagaacgggugggagggcauggucgacgggugguacggcuuccggcaccagaacuccgaggggaccggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagcggcagcugcgcgagaacgccgaggacauggggaacggcugcuucaagaucuaccacaagugcgacaacgcgugcaucgggagcauccgcaacggcacguacgaccacgacguguaccggaacgaggcccucaacaaccgcuuccagaucaagggcguggagcugaaguccggguacaaggacuggauccuguggaucucguucgccaucagcugcuuccuccugugcgucgcccugcucggcuucaucaugugggccugccagaaggggaacauccggugcaacaucugcaucuga

SEQ ID NO: 1555 - RNA, 1701 nt, Artificial Sequence
  derived and/or modified CDS sequence (AUadapt) from InfluenzaA__ABI92676__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccucguccgggacgcuggaguucaacaacgagagcuucgacuggaccggcgugacccagaacgggaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccucgggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcaacggcaaguccucgaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 1556 - RNA, 1701 nt, Artificial Sequence
  derived and/or modified CDS sequence (AUadapt) from InfluenzaA__ABI92687__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgcggcuccaacaagucguucuucucccggcugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccgcaucaccgugucgacgaagcggucccagcagaccgugaucccgaacaucgggucgcgcccccggguccgcgacguguccagccggaucuccaucuacuggaccaucgugaagcccggcgacauccugcucaucaacucgaccgggaaccugaucgcgccccgcggcuacuucaagauccgguccggcaagucguccaucaugcgcagcgacgccccgaucgggaagugcaacuccgagugcaucacgcccaacggcucgauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggcuucaucgagaacgggugggagggcauggucgacgggugguacggcuuccggcaccagaacuccgaggggaccggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagcggcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggcguggagcugaaguccggguacaaggacuggauccuguggaucucguucgccaucagcugcuuccuccugugcgucgcccugcucggcuucaucaugugggccugccagaaggggaacauccggugcaacaucugcaucuga

SEQ ID NO: 1557 - RNA, 1701 nt, Artificial Sequence; identical to SEQ ID NO: 1556
  derived and/or modified CDS sequence (AUadapt) from InfluenzaA__ABI92698__HA

SEQ ID NO: 1558 - RNA, 1701 nt, Artificial Sequence; identical to SEQ ID NO: 761
  derived and/or modified CDS sequence (AUadapt) from InfluenzaA__ABI92709__HA

SEQ ID NO: 1559 - RNA, 1701 nt, Artificial Sequence
  derived and/or modified CDS sequence (AUadapt) from InfluenzaA__ABI92720__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgagucggaccagaucucccuguacgcgcaggccucgggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 1560 - RNA, 1701 nt, Artificial Sequence
  derived and/or modified CDS sequence (AUadapt) from InfluenzaA__ABI92731__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagcgccagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggccugccagaagggcaacauccgcugcaacaucugcaucuga

SEQ ID NO: 1561 - RNA, 1701 nt, Artificial Sequence
  derived and/or modified CDS sequence (AUadapt) from InfluenzaA__ABI92742__HA
augaagaccaucaucgcccugucguacauccucugccugguguucucccagaagcugcccggcaacgacaacucgaccgccacgcucugccuggggcaccacgcggucccgaacggcaccaucgugaagaccaucaccaacgaccagaucgaggugacgaacgccaccgagcugguccaguccagcuccaccgggggcaucugcgacucgccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggaccacgccucccugcggagccucgucgcguccucggggacgcuggaguucaacaacgaguccuucgacuggaccggcgugacccagaacgggaccucguccgccugcaagcgccggagcaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcccaggcgagcggccggaucaccguguccacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccucgaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggccgcgaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacguguaccgggacgaggcgcucaacaaccgcuuccagaucaagggcguggagcucaagucgggcuacaaggacuggauccuguggaucagcuucgccaucuccugcuuccugcugugcgucgcccugcucggguucaucaugugggccugccagaagggcaacauccggugcaacaucugcaucuga

SEQ ID NO: 1562 - RNA, 1701 nt, Artificial Sequence
  derived and/or modified CDS sequence (AUadapt) from InfluenzaA__ABI92753__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcguaccugcggagccucgucgccuccucggggacgcuggaguucaacaacgaguccuucgacuggaccggcgugacccagaacgggaccucguccgccugcaagcgccggagcaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugucgacgaagcgcucgcagcagaccgugaucccgaacaucggcucccggccccgcguccgggacgugagcucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagcgccagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 1563 - RNA, 1701 nt, Artificial Sequence
  derived and/or modified CDS sequence (AUadapt) from InfluenzaA__ABI92764__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagucguucgacuggaccggggugacccagaacggcaccuccagcgccugcaagcgcggguccaacaagucguucuucucccggcugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccgcaucaccgugucgacgaagcggucccagcagaccgugaucccgaacaucggcucgcgcccccggguccgcgacguguccagccggaucuccaucuacuggaccaucgugaagcccggggacauccugcucaucaacucgaccggcaaccugaucgcgccccgcggguacuucaagauccgguccggcaagucguccaucaugcgcagcgacgccccgaucggcaagugcaacuccgagugcaucacgcccaacgggucgauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagcggcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 1564 - RNA, 1701 nt, Artificial Sequence; identical to SEQ ID NO: 1556
  derived and/or modified CDS sequence (AUadapt) from InfluenzaA__ABI92775__HA

SEQ ID NO: 1565 - RNA, 1701 nt, Artificial Sequence; identical to SEQ ID NO: 488
  derived and/or modified CDS sequence (AUadapt) from InfluenzaA__ABI92786__HA

SEQ ID NO: 1566 - RNA, 1701 nt, Artificial Sequence
  derived and/or modified CDS sequence (AUadapt) from InfluenzaA__ABI92797__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagagcuucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugucgacgaagcgcagccagcagaccgugaucuccaacaucggcucgcggccgcgcguccgggacauccccucccgcaucagcaucuacuggaccaucgugaagcccggggacauccugcucaucaacuccaccggcaaccugaucgcgccccggggguacuucaagauccgcucgggcaaguccucgaucaugcgguccgacgccccgaucggcaagugcaacagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1567 - RNA, 1701 nt, Artificial Sequence; identical to SEQ ID NO: 488
  derived and/or modified CDS sequence (AUadapt) from InfluenzaA__ABI92808__HA

SEQ ID NO: 1568 - RNA, 1701 nt, Artificial Sequence; identical to SEQ ID NO: 488
  derived and/or modified CDS sequence (AUadapt) from InfluenzaA__ABI92819__HA

SEQ ID NO: 1569 - RNA, 1701 nt, Artificial Sequence; identical to SEQ ID NO: 488
  derived and/or modified CDS sequence (AUadapt) from InfluenzaA__ABI92841__HA

SEQ ID NO: 1570 - RNA, 1701 nt, Artificial Sequence
  derived and/or modified CDS sequence (AUadapt) from InfluenzaA__ABI92852__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcuaccggccccgcguccgggacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1571 - RNA, 1701 nt, Artificial Sequence
  derived and/or modified CDS sequence (AUadapt) from InfluenzaA__ABI92863__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggcccacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaaccagucguucuucucccgccugaacuggcucacgcaccugaaguucaaguaccccgcccugaacgugaccaugcccaacaacgagaaguucgacaagcucuacaucuggggcgugcaccaccccgggaccgacagcgaccagaucucccuguacgcgcaggccccgggccggaucaccgucucgacgaagcgcucgcagcagaccgugauccccaacaucggcucccggccccgcgugcgggacaucucgucccgcaucagcaucuacuggaccaucgucaagcccggggacauccugcucaucaacuccaccggcaaccugaucgccccgcggggguacuucaagauccgcucgggcaaguccucgaucaugaaguccgacgcccccaucggccggugcaacucggagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcugaaguccggcuacaaggacuggauccuguggaucuccuucgccaucagcugccuccugcugugcguggcccuccugggguucaucaugugggccugccagaagggcaacauccggugcaacaucugcaucuga

SEQ ID NO: 1572 - RNA, 1701 nt, Artificial Sequence; identical to SEQ ID NO: 488
  derived and/or modified CDS sequence (AUadapt) from InfluenzaA__ABI92874__HA

SEQ ID NO: 1573 - RNA, 1701 nt, Artificial Sequence; identical to SEQ ID NO: 488
  derived and/or modified CDS sequence (AUadapt) from InfluenzaA__ABI92885__HA

SEQ ID NO: 1574 - RNA, 1701 nt, Artificial Sequence
  derived and/or modified CDS sequence (AUadapt) from InfluenzaA__ABI92907__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucccccuaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgucagccugcggucccucguggcgucguccgggacgcuggaguucaacaacgagagcuucaacuggaccggcgugacccagaacgggaccuccucggccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucucgcuguacgcccaggcguccggccggaucaccgugagcacgaagcgcucgcagcagaccgucaucccgaacaucggcucccggccccgcgugcgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacuccgagggcaucgggcaggccgccgaccucaagucgacccaggccgcgaucaaccagaucaacggcaagcugaaccggcugaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggaccuacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 1575 - RNA, 1701 nt, Artificial Sequence; identical to SEQ ID NO: 488
  derived and/or modified CDS sequence (AUadapt) from InfluenzaA__ABI92918__HA

SEQ ID NO: 1576 - RNA, 1701 nt, Artificial Sequence; identical to SEQ ID NO: 1574
  derived and/or modified CDS sequence (AUadapt) from InfluenzaA__ABI92929__HA

SEQ ID NO: 1577 - RNA, 1701 nt, Artificial Sequence
  derived and/or modified CDS sequence (AUadapt) from InfluenzaA__ABI92940__HA
augaagaccaucaucgccuucaacuacauccugugccucguguucgcccagaagcugcccggcaacgacaacucgaccgcgacgcugugccucgggcaccacgccgucccgaacggcaccaucgugaagaccaucaccaacgaccagaucgaggugacgaacgccaccgagcugguccaguccucguccaccgggggcaucugcgacagcccccaccagauccuggacggggagaacugcacccucaucgacgcccugcugggcgacccccagugcgacggcuuccagaacaagaagugggaccucuucguggagcgcuccaaggccuacucgaacugcuaccccuacgacgugccggacuacgcgucccugcggucgcuggucgccuccagcgggacgcucgaguucaacaacgagaucuucaacuggaccggcgugacccagaacgggaccuccucggccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaucagccucuacgcgcaggccuccggccggaucaccgugucgacgaagcgcucccagcagaccgugaucccgaacaucggcucgcggccccgcguccgggacauccccagccgcaucuccaucuacuggaccaucgugaagcccggggacauccugcugaucaacucgaccggcaaccucaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagucgacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacacgaagaucgaccuguggagcuacaacgccgagcugcucguggcccuggagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggacguacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 1578 - RNA, 1701 nt, Artificial Sequence
  derived and/or modified CDS sequence (AUadapt) from InfluenzaA__ABI92951__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacuccugcaucggcagcauccgcaacgggaccuacgaccacgacguguaccgggacgaggcgcucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 1579 - RNA, 1701 nt, Artificial Sequence
  derived and/or modified CDS sequence (AUadapt) from InfluenzaA__ABI92962__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcaacaaggccuacagcaacugcuaccccuacgacgugccggacuacgcgucccugcggucgcucaucgccuccagcgggacgcuggaguucaacaacgaguccuucaacuggaccggcgucacccagaacgggaccucguccgccugcaagcgccggucgaacuccagcuucuucucccgccugaacuggcucacgcaccugaaguucaaguaccccgcccugaacgugaccaugcccaacaacgaggaguucgacaagcucuacaucuggggcgugcaccaccccgggaccuacaacgaccagaucucgcuguacgcgcaggccuccggccggaucaccgucagcacgaagcgcucgcagcagaccgugaucccgaacaucggcucccggccccgcgugcgggacauccccagccgcaucuccaucuacuggaccaucgucaagcccggggacauccugcucaucaacucgaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 1580 - RNA, 1701 nt, Artificial Sequence; identical to SEQ ID NO: 878
  derived and/or modified CDS sequence (AUadapt) from InfluenzaA__ABI92973__HA

SEQ ID NO: 1581 - RNA, 1701 nt, Artificial Sequence; identical to SEQ ID NO: 878
  derived and/or modified CDS sequence (AUadapt) from InfluenzaA__ABI92984__HA

SEQ ID NO: 1582 - RNA, 1701 nt, Artificial Sequence
  derived and/or modified CDS sequence (AUadapt) from InfluenzaA__ABI92995__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcauccgggacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgucaaccgcaucaccuacggcgccugccccaaguacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacucggagggcaucgggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacacgaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 1583 - RNA, 1701 nt, Artificial Sequence; identical to SEQ ID NO: 878
  derived and/or modified CDS sequence (AUadapt) from InfluenzaA__ABI93006__HA

SEQ ID NO: 1584 - RNA, 1701 nt, Artificial Sequence; identical to SEQ ID NO: 878
  derived and/or modified CDS sequence (AUadapt) from InfluenzaA__ABI93017__HA

SEQ ID NO: 1585 - RNA, 1698 nt, Artificial Sequence; identical to SEQ ID NO: 1477
  derived and/or modified CDS sequence (AUadapt) from InfluenzaA__ABI93028__HA

SEQ ID NO: 1586 - RNA, 1701 nt, Artificial Sequence; identical to SEQ ID NO: 1211
  derived and/or modified CDS sequence (AUadapt) from InfluenzaA__ABI93039__HA

SEQ ID NO: 1587 - RNA, 1701 nt, Artificial Sequence
  derived and/or modified CDS sequence (AUadapt) from InfluenzaA__ABI93061__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucagcaucuacuggacgaucgucaagcccggcgacauccuccugaucaacuccaccgggaaccugaucgcgccccggggcuacuucaagauccgcucggggaaguccagcaucaugcgguccgacgccucgaucggcaagugcaacuccgagugcaucaccccgaacggcagcauccccaacgacaagcccuuccagaacgugaaccgcaucaccuacggggccugcccccgguacgugaagcagaacacgcucaagcuggccaccggcaugcgcaacgucccggagaagcagacccgggggaucuucggcgccaucgccggguucaucgagaacggcugggagggcaugguggacgggugguacggcuuccgccaccagaacuccgaggggaccggccaggccgcggaccugaaguccacgcaggccgccaucaaccagaucaacgggaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcucaagucgggguacaaggacuggauccuguggaucuccuucgccaucagcugcuuccugcugugcgugguccuccugggcuucaucaugugggccugccagaagggcaacauccggugcaacaucugcaucuga

SEQ ID NO: 1588 - RNA, 1701 nt, Artificial Sequence; identical to SEQ ID NO: 895
  derived and/or modified CDS sequence (AUadapt) from InfluenzaA__ABI93072__HA

SEQ ID NO: 1589 - RNA, 1701 nt, Artificial Sequence; identical to SEQ ID NO: 895
  derived and/or modified CDS sequence (AUadapt) from InfluenzaA__ABI93083__HA

SEQ ID NO: 1590 - RNA, 1701 nt, Artificial Sequence; identical to SEQ ID NO: 895
  derived and/or modified CDS sequence (AUadapt) from InfluenzaA__ABI93094__HA

SEQ ID NO: 1591 - RNA, 1701 nt, Artificial Sequence; identical to SEQ ID NO: 895
  derived and/or modified CDS sequence (AUadapt) from InfluenzaA__ABI93105__HA

SEQ ID NO: 1592 - RNA, 1701 nt, Artificial Sequence
  derived and/or modified CDS sequence (AUadapt) from InfluenzaA__ABI93116__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagccggaucuccaucuacuggacgaucgucaagcccggggacauccuccugaucaacugcaccggcaaccugaucgccccgcgcggguacuucaagaugcggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgggguguaccgcgacgaggcccugaacaaccgguuccagaucaagggcgucgagcugaaguccggcuacaaggacuggauccucuggaucucguucgccaucagcugcuuccugcugugcgugguccuccugggguucaucaugugggccugccagaagggcaacauccgcugcaacaucugcaucuga

SEQ ID NO: 1593 - RNA, 1689 nt, Artificial Sequence
  derived and/or modified CDS sequence (AUadapt) from InfluenzaA__ABI94581__HA
augaauacccagauccugguguucgcccucgucgccucgauccccaccaacgcggacaagaucugccugggccaccacgccguguccaaugggacgaaggugaacacccugaccgagcgcggcgucgagguggugaacgccaccgagacggucgagcggaccaacgugccgcgcaucugcagcaaggggaagcggaccguggaccucggccagugcgggcugcugggcaccaucacgggcccgccccagugugaccaguuccucgaguucuccgccgaccugaucaucgagcgccgggaggggagcgacgucugcuaucccggcaaguucgugaacgaggaggcccugcgccagauccuccgggaguccgggggcaucgacaaggagaccaugggguucaccuacagcggcauccgcaccaacggcacgaccuccgcgugucggcgcagcggguccagcuucuacgccgagaugaaguggcugcuguccaacaccgacaacgccgccuuuccgcagaugaccaagagcuacaagaacacgcggaaggaccccgcgcucaucaucuggggcauccaccacuccgggagcaccaccgagcagaccaagcuguauggcuccggcaacaagcugaucacgguggggagcuccaacuaccagcagagcuucguccccucccccggcgcccgcccccaggugaacgggcagaguggccggaucgacuuccacuggcucauccugaaccccaacgacaccgugaccuucaguuucaacggggccuucaucgcccccgaccgcgccuccuuccugcggggcaagagcaugggcauccaguccgagguccagguggacgcgaauugcgagggggacugcuaccacagcggcgggaccaucaucuccaaccuccccuuucagaacaucaacagccgcgccgugggcaagugcccgcgguacgucaagcaggagucccugcugcucgccacggggaugaagaacgugcccgagauccccaagcgccggcgccggggccuguucggcgccaucgccggguuuaucgagaacggcugggaggggcugaucgacggcugguacggguuccgccaccagaacgcgcagggcgagggcaccgccgccgacuauaagagcacccaguccgccaucgaccagaucaccgggaagcucaaccgccugaucgagaagacgaaccagcaguucgagcugaucgacaacgaguuuaccgagguggagaagcagaucggcaacgucaucaacuggacccgggacagcaugaccgaggugugguccuacaacgccgagcuccugguggcgauggagaaccagcauacgaucgaccuggccgacagcgagaugaacaagcucuacgagcgcgucaagcggcagcugcgcgagaacgccgaggaggacgggaccggcuguuucgagaucuuccacaagugcgacgacgacuguauggccuccauccggaacaacaccuacgaccacagcaaguaccgcgaggaggccauccagaaucggauccagaucgaccccgugaagcuguccagcggcuacaaggacgucauccucugguucuccuucggggcgagcuguuucauccugcuggccaucgccaugggccucguguucaucugcgugaagaacgggaacaugcgcugcaccaucugcaucuga

SEQ ID NO: 1594 - RNA, 1701 nt, Artificial Sequence; identical to SEQ ID NO: 1011
  derived and/or modified CDS sequence (AUadapt) from InfluenzaA__ABI95228__HA

SEQ ID NO: 1595 - RNA, 1701 nt, Artificial Sequence
  derived and/or modified CDS sequence (AUadapt) from InfluenzaA__ABI95239__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggauggugaacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 1596 - RNA, 1698 nt, Artificial Sequence
  derived and/or modified CDS sequence (AUadapt) from InfluenzaA__ABI95250__HA
augaaggccaagcugcucgugcugcugugcaccuucaccgccacguacgcggacaccaucugcgucggcuaccacgccaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucuccaaggagagcugguccuacaucguggagacccccaaccccgagaacggcacgugcuaccccggcuacuucgccgacuacgaggagcugcgcgagcagcugagcuccgugucguccuucgagcgguucgagaucuucccgaaggagagcuccuggcccaaccacaccgucaccggggugagcgccuccugcagccacaacggcaaguccagcuucuaccgcaaccuccuguggcugaccgagaagaacgggcucuaccccaaccuguccaagucguacgugaacaacaaggagaaggagguccuggugcucuggggcgugcaccaccccagcaacaucggggaccagcgggccaucuaccacacggagaacgccuacgucuccguggugagcucccacuacagccgccgguucaccccggagaucgccaagcgccccaagguccggggccaggagggccgcaucaacuacuacuggacccugcuggagcccggggacaccaucaucuucgaggcgaacggcaaccucaucgcccccugguacgccuucgcccugucccggggguucggcagcggcaucaucacguccaacgccccgaugaacgagugcgacgcgaagugccagacgccccagggggccaucaacucgucccugcccuuccagaacgugcaccccgugaccaucggcgagugcccgaaguacguccgcagcgccaagcuccggauggugaccgggcugcgcaacauccccuccauccagagccggggccuguucggggccaucgccggcuucaucgagggcggguggaccggcaugaucgacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcucgagcgccggauggagaaccugaacaagaaggucgacgacggcuuccuggacaucuggaccuacaacgccgagcuccuggugcugcucgagaacgagcgcacccuggacuuccacgacagcaacgugaagaaccuguacgagaaggucaagucccagcucaagaacaacgcgaaggagaucgggaacggcugcuucgaguucuaccacaagugcaacaacgagugcauggagucggugaagaacgggaccuacgacuaccccaaguacuccgaggagagcaagcugaaccgggagaagaucgacggcgugaagcuggagagcaugggcgucuaccagauccucgccaucuacuccacgguggccagcucccuggugcugcucgucagccugggggccaucuccuucuggaugugcagcaacggcucccugcagugccgcaucugcaucuga

SEQ ID NO: 1597 - RNA, 1698 nt, Artificial Sequence
  derived and/or modified CDS sequence (AUadapt) from InfluenzaA__ABI95261__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagucguccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccacacggagaacgccuacgucuccguggugagcucccacuacucgcgccgguucaccccggagaucgccaagcgccccaagguccgggaccaggagggccgcaucaacuacuacuggacccugcuggagcccggcgacaccaucaucuucgaggcgaacgggaaccucaucgcccccugguacgccuucgcccugucccggggcuucgagagcgggaucaucacguccaacgccccgaugaacgagugcgacgcgaagugccagacgccccagggcgccaucaacagcucccugcccuuccagaacgugcaccccgugaccaucggcgagugcccgaaguacguccgcagcgccaagcuccggauggugaccgggcugcgcaacauccccuccauccagagccggggccuguucggggccaucgccggcuucaucgagggcggguggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcucgagcgccggauggagaaccugaacaagaaggucgacgacggcuuccuggacaucuggaccuacaacgccgagcuccuggugcugcucgagaacgagcgcacccuggacuuccacgacucgaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuaccccaaguacuccgaggagagcaagcugaaccgggagaagaucgacggcgugaagcuggagagcaugggggucuaccagauccucgccaucuacuccacgguggccagcucccuggugcugcucgucagccugggcgccaucuccuucuggaugugcagcaacggcucccugcagugccgcaucugcaucuga

SEQ ID NO: 1598 - RNA, 1698 nt, Artificial Sequence; identical to SEQ ID NO: 1477
  derived and/or modified CDS sequence (AUadapt) from InfluenzaA__ABI95272__HA

SEQ ID NO: 1599 - RNA, 1698 nt, Artificial Sequence; identical to SEQ ID NO: 1477
  derived and/or modified CDS sequence (AUadapt) from InfluenzaA__ABI95283__HA

SEQ ID NO: 1600 - RNA, 1698 nt, Artificial Sequence; identical to SEQ ID NO: 541
  derived and/or modified CDS sequence (AUadapt) from InfluenzaA__ABI95294__HA

SEQ ID NO: 1601 - RNA, 1698 nt, Artificial Sequence
  derived and/or modified CDS sequence (AUadapt) from InfluenzaA__ABI96104__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugaucaagagcuacgccaacaacaaggagaaggaggugcucauccuguggggcgugcaccacccgcccaacaucggggaccagcggacccuguaccacacggagaacgccuacgucuccguggugucgagccacuacucccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucagccggggguucggcuccggcaucaucaccagcaacgcccccauggacgagugcgacgccaagugccagacgccccagggggcgaucaacuccagccugcccuuccagaacgugcacccggugaccaucggcgagugccccaaguacguccgcuccgccaagcugcggauggugaccgggcuccgcaacauccccucgauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgucaagaaccuguacgagaaggucaagagccagcugaagaacaacgccaaggagaucgggaacggcugcuucgaguucuaccacaagugcaacaacgagugcauggaguccgugaagaacgggacguacgacuaccccaaguacagcgaggaguccaagcucaaccgggagaagaucgacggcgugaagcuggacucgaugggcguguaccagauccuggcgaucuacuccaccguggccagcagccucguccugcuggugucccucggggccaucagcuucuggaugugcuccaacggcagccugcagugccgcaucugcaucuga

SEQ ID NO: 1602 - RNA, 1701 nt, Artificial Sequence; identical to SEQ ID NO: 895
  derived and/or modified CDS sequence (AUadapt) from InfluenzaA__ABJ09107__HA

SEQ ID NO: 1603 - RNA, 1701 nt, Artificial Sequence
  derived and/or modified CDS sequence (AUadapt) from InfluenzaA__ABJ09140__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccucguccggcacgcuggaguucaucaacgaggacuucaacuggaccgggguggcccaggacggcaagagcuacuccugcaagcgcgggagcgugaacuccuucuucucgcggcucaacuggcugcacaagcuggaguacaaguaccccgcccucaacgucaccaugcccaacaacggcaaguucgacaagcuguacaucuggggcgugcaccaccccuccaccgacagcgaccagacgucccuguacgugcgcgcgagcgggcgggucaccgugucgaccaagcgcucccagcagaccgugaucccgaacaucggcuuccggcccuggguccgcgggcucagcucccggaucucgaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccucggagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggccgcgaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccggccugcucguggcccuggagaaccagcacaccaucgaccugacggacucggagaugaacaagcuguucgagcgcacccgcaagcagcuccgggagaacgccgaggacauggggaacggcugcuucaagaucuaccacaagugcgacaacgccugcaucggguccauccgcaacggcaccuacgaccacgacgucuaccgggacgaggcgcugaacaaccgcuuccagaucaagggcguggagcucaagagcggguacaaggacuggauccuguggaucuccuucgccaucagcugcuuccugcucugcgucgugcugcugggcuucaucaugugggccugccagaaggggaacauccggugcaacaucugcaucuga

SEQ ID NO: 1604 - RNA, 1698 nt, Artificial Sequence
  derived and/or modified CDS sequence (AUadapt) from InfluenzaA__ABJ09151__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaagggcaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggcuucgggagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccggggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccaaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacggcucccugcagugccgcaucugcaucuga

SEQ ID NO: 1605 - RNA, 1701 nt, Artificial Sequence
  derived and/or modified CDS sequence (AUadapt) from InfluenzaA__ABJ09162__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccaacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagucgacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagauccucguggcccuggagaaccagcacacgaucgaccugaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 1606 - RNA, 1701 nt, Artificial Sequence; identical to SEQ ID NO: 488
  derived and/or modified CDS sequence (AUadapt) from InfluenzaA__ABJ09173__HA

SEQ ID NO: 1607 - RNA, 1698 nt, Artificial Sequence
  derived and/or modified CDS sequence (AUadapt) from InfluenzaA__ABJ09184__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggaggcgggggacaccaucaucuucgaggccaacggcaaccugaucgcgccccgguucgccuucgcccucucccgcggguucggcucgggcaucaucacguccaacgccccgauggacgagugcgacgccaagugccagacgccccagggggccaucaacagcucccugcccuuccagaacguccaccccgugaccaucggcgagugcccgaaguacgugcggagcgccaagcugcgcauggccaccgggcuccggaacauccccuccauccagagccgcggccuguucggggcgaucgccggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggcggucgggaaggaguucagcaagcuggagcggcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacggucgccuccagccucgugcugcuggugucccucggggcgaucagcuucuggaugugcuccaacggcagccugcagugccggaucugcaucuga

SEQ ID NO: 1608 - RNA, 1701 nt, Artificial Sequence; identical to SEQ ID NO: 878
  derived and/or modified CDS sequence (AUadapt) from InfluenzaA__ABJ09195__HA

SEQ ID NO: 1609 - RNA, 1701 nt, Artificial Sequence; identical to SEQ ID NO: 878
  derived and/or modified CDS sequence (AUadapt) from InfluenzaA__ABJ09206__HA

SEQ ID NO: 1610 - RNA, 1701 nt, Artificial Sequence; identical to SEQ ID NO: 1458
  derived and/or modified CDS sequence (AUadapt) from InfluenzaA__ABJ09217__HA

SEQ ID NO: 1611 - RNA, 1701 nt, Artificial Sequence; identical to SEQ ID NO: 895
  derived and/or modified CDS sequence (AUadapt) from InfluenzaA__ABJ09228__HA

SEQ ID NO: 1612 - RNA, 1701 nt, Artificial Sequence
  derived and/or modified CDS sequence (AUadapt) from InfluenzaA__ABJ09239__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgauggaguucaacaacgagucguucaacuggaccggcguggcccagaacgggaccuccagcgccugcaagcgccgguccaacaagucguucuucucccgccugaacuggcuccaccagcugaaguacaaguaccccgcgcugaacgugaccaugcccaacaacgagaaguucgacaagcucuacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagccggaucuccaucuacuggacgaucgucaagcccggggacauccugcucaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcugaagcucgccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacaccaucgaccucacggacuccgagaugaacaagcuguucgagcgcaccaagaagcagcugcgggagaacgcggaggacauggggaacggcugcuucaagaucuaccacaagugcgacaacgccugcaucgggagcauccgcaacggcaccuacgaccacgacguguaccgcgacgaggcccucaacaaccgguuccagaucaagggggucgagcugaaguccggcuacaaggacuggauccuguggaucucguucgccaucagcugcuuccuccugugcgugguccugcucggcuucaucaugugggccugccagaaggggaacauccgcugcaacaucugcaucuga

SEQ ID NO: 1613 - RNA, 1701 nt, Artificial Sequence
  derived and/or modified CDS sequence (AUadapt) from InfluenzaA__ABJ09250__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucugggggauccaccaccccagcacggacuccgaccagaucucgcuguacgcccaggccagcggccgcgucaccguguccaccaagcggucgcagcagaccgugaucccgaacaucgggucccgccccuggguccggggcgugagcucccgcaucucgaucuacuggacgaucgugaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacgcucaagcuggccaccggcaugcgcaacgugcccgagaagcagacccgggggaucuucggcgccaucgccggguucaucgagaacggcugggagggcauggucgacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgagaccuacgaccacgacguguaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 1614 - RNA, 1701 nt, Artificial Sequence
  derived and/or modified CDS sequence (AUadapt) from InfluenzaA__ABJ09261__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggaagaucugcgacucgccccaccagauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaacaacgagucguucaacuggaccgggguggcccagaacggcaccuccucggccugcaagcgccgguccaucaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaccagccuguacgcccaggccucggggcgggugaccguguccaccaagcgcagccagcagacggucaucccgaacaucgggucccggcccugggugcgcggcgugucgucccggaucucgaucuacuggaccaucgucaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacucggaggggacgggccaggccgcggaccugaaguccacccaggccgccaucaaccagaucaacgggaagcucaaccgccugaucgagaagaccaacgagaaguaccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacucggagaugaacaagcuguucgagcgcacccggaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 1615 - RNA, 1701 nt, Artificial Sequence
  derived and/or modified CDS sequence (AUadapt) from InfluenzaA__ABJ09272__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcaacucgccccaccagauccuggacggcgagaacugcacccugaucgacgcccuccugggggacccccacugcgacggcuuccagaacaaggagugggaccuguucguggagcggcgcaaggccuacagcaacugcuaccccuacgacgugccggacuacgcgucccuccggucgcuggucgccuccagcggcacgcuggaguucaacaacgaguccuucaacuggaccgggguggcccagaacggcaccucguccgccugcaagcgccggucgaucaaguccuucuucagccgccucaacuggcugcaccagcugaaguacaaguaccccgcgcucaacgugaccaugcccaacaacgagaaguucgacaagcuguacaucuggggcguccaccaccccuccacggacucggaccagaucucccuguacgcccaggccagcgggcgggugaccgugucgaccaagcgcucccagcagaccgucaucccgaacaucgggagccggcccugggugcgcggcguguccucgcggaucuccaucuacuggacgaucgucaagcccggcgacauccuccugaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucgagaagaccaacgagaaguuccaccagaucgagaaggaguucuccgagguggagggccggauccaggaccuggagaaggacgucgaggacaccaagaucgaccucuggucguacaacgccgagcugcugguggcccucgagaaccagcacaccaucgaccugacggacuccgagaugaacaagcuguucgagcgcaccaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcugaaguccggguacaaggacuggauccucuggaucucguucgccaucagcugcuuccugcugugcgugguccuccugggcuucaucaugugggccugccagaagggcaacauccgcugcaacaucugcaucuga

SEQ ID NO: 1616 - RNA, 1701 nt, Artificial Sequence; identical to SEQ ID NO: 317
  derived and/or modified CDS sequence (AUadapt) from InfluenzaA__ABJ09294__HA

SEQ ID NO: 1617 - RNA, 1701 nt, Artificial Sequence
  derived and/or modified CDS sequence (AUadapt) from InfluenzaA__ABJ09305__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgucgcuccgcucccuggucgccagcuccggcacgcuggaguucaacaacgagucguucaacuggaccgggguggcccagaacggcaccuccagcgccugcaagcggcgcuccaacaagucguucuucucccggcucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgcgugaccguguccaccaagcggucgcagcagaccgucaucccgaacaucgggucccgccccugggugcggggcgugagcucccgcaucucgaucuacuggacgaucgucaagcccggcgacauccuccugaucaacuccaccgggaaccugaucgcgccccggggcuacuucaagauccgcagcgggaaguccucgaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccgcaacgagaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggguucaucaugugggccugccagaagggcaacauccggugcaacaucugcaucuga

SEQ ID NO: 1618 - RNA, 1701 nt, Artificial Sequence
  derived and/or modified CDS sequence (AUadapt) from InfluenzaA__ABJ09316__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccacugggugcggggcgugucgucccgcaucagcaucuacuggacgaucgucaagcccggcgacauccuccugaucaacuccaccgggaaccugaucgcgccccggggcuacuucaagauccgcucggggaaguccagcaucaugcgguccgacgccucgaucggcaagugcaacuccgagugcaucacccccaacggcagcaucccgaacgacaagcccuuccagaacgugaaccgcaucaccuacggggccugcccccgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacuccgaggggaccggccaggccgcggaccugaaguccacgcaggccgccaucaaccagaucaacgggaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcucaagucgggguacaaggacuggauccuguggaucuccuucgccaucagcugcuuccugcugugcgugguccuccugggcuucaucaugugggccugccagaagggcaacauccggugcaacaucugcaucuga

SEQ ID NO: 1619 - RNA, 1701 nt, Artificial Sequence; identical to SEQ ID NO: 895
  derived and/or modified CDS sequence (AUadapt) from InfluenzaA__ABJ09338__HA

SEQ ID NO: 1620 - RNA, 1701 nt, Artificial Sequence
  derived and/or modified CDS sequence (AUadapt) from InfluenzaA__ABJ09349__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucauccagucguccagcaccgggggcaucugcgacucgccccaccagauccuggacggggagaacugcacccugaucgacgcccuccugggcgacccccacugcgacggcuuccagaacaaggagugggaccuguucgucgagcgcagcaaggccuacuccaacugcuaccccuacgacgugccggacuacgcgucgcuccggucccugguggccagcuccgggacgcuggaguucaacaacgagucguucaacuggaccggcgucgcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcgugcaccaccccagcacggacuccgaccagaucucgcuguacgcccaggccccggggcgggucaccgugagcaccaagcgcucccagcagaccgugauccccaacaucggcucgcggcccuggguccgcggcguguccagccggaucuccaucuacuggacgaucgugaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgucaaccggaucaccuacggcgcgugcccgcgcuacgugaagcagaacacgcucaagcuggccaccgggaugcggaacgugcccgagaagcagacccgcggcaucuucggggccaucgccggcuucaucgagaacggcugggaggggauggucgacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacguggaggacaccaagaucgaccucuggucguacaacgccgagcugcuggucgcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaaggggguggagcugaaguccggcuacaaggacuggauccucuggaucucguucgccaucagcugcuuccugcugugcgucgugcuccugggcuucaucaugugggccugccagaaggggaacauccgcugcaacaucugcaucuga

SEQ ID NO: 1621 - RNA, 1701 nt, Artificial Sequence; identical to SEQ ID NO: 895
  derived and/or modified CDS sequence (AUadapt) from InfluenzaA__ABJ09360__HA

SEQ ID NO: 1622 - RNA, 1701 nt, Artificial Sequence
  derived and/or modified CDS sequence (AUadapt) from InfluenzaA__ABJ09371__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucucgacgaagcgcucccagcagaccgugaucccgaacaucggcagccggcugcgcgugcgggacauccccucccgcaucucgaucuacuggaccaucgucaagcccggggacauccuccugaucaacuccaccggcaaccugaucgcgccccggggguacuucaagauccgcagcggcaaguccucgaucaugcgguccgacgccccgaucggcaagugcaacagcgagugcaucacgcccaacggguccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcucaaccggcugaucggcaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacucggagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 1623 - RNA, 1701 nt, Artificial Sequence; identical to SEQ ID NO: 878
  derived and/or modified CDS sequence (AUadapt) from InfluenzaA__ABJ09382__HA

SEQ ID NO: 1624 - RNA, 1701 nt, Artificial Sequence
  derived and/or modified CDS sequence (AUadapt) from InfluenzaA__ABJ16587__HA
augaagaccaucaucgcccugucguacaucuccugccucguguucgcccagaagcugcccggcaacgacaacucgaccgcgacgcugugccucgggcaccacgccgucccgaacggcacccuggugaagaccaucaccaacgaccagaucgaggugacgaacgccaccgagcugguccaguccagcuccaccgggcgcaucugcgacucgccccaccagauccucgacggcgagaacugcacccugaucgacgcccugcucggggacccccacugcgacggcuuccagaacaaggagugggaccuguucguggagcgguccaaggccuacagcaacugcuaccccuacgacgugccggacuacgcgucccugcgcucgcucgucgccuccagcggcacgcuggaguucaacaacgaguccuucaacuggaccgggguggcccagaacggcaccucguccgccugcaagcggcgcagcaucaaguccuucuucucgcggcugaacuggcuccaccagcugaaguaccgcuaccccgcgcugaacgugaccaugcccaacaacgacaaguucgacaagcucuacaucuggggcguccaccaccccuccacggacagcgaccagaccucgcuguacgcccaggccuccgggcgggugaccgugucgaccaagcgcucccagcagacggucaucccgaacaucgggagccggcccugggugcgcggcguguccucgcggaucuccaucuacuggaccaucgucaagcccggcgacauccugcucaucaacagcaccgggaaccugaucgcgccccgcggcuacuucaagauccgguccggcaagucguccaucaugcgcagcgacgccccgaucgggaagugcaacuccgagugcaucacccccaacggcucgauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugauggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacguggaggacaccaagaucgaccuguggucguacaacgccgagcuccuggucgcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcguggagcucaagucgggguacaaggacuggauccuguggaucuccuucgccaucagcugcuuccugcugugcgucgugcugcucggcuucaucaugugggccugccagaagggcaacauccggugcaacaucugcaucuga

SEQ ID NO: 1625 - RNA, 1701 nt, Artificial Sequence
  derived and/or modified CDS sequence (AUadapt) from InfluenzaA__ABJ16598__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcaacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgcgagccuccgcucccuggucgccucguccggcacgcuggaguucaacaacgagagcuucaacuggaccgggguggcccagaacggcaccuccucggccugcaagcggcgcuccaucaagagcuucuucucccggcucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccucggggcgcgugaccguguccaccaagcggagccagcagaccgucaucccgaacaucgggucccgccccugggugcggggcgugucgucccgcaucagcaucuacuggacgaucgucaagcccggcgacauccuccugaucaacuccaccgggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucucggagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 1626 - RNA, 1701 nt, Artificial Sequence
  derived and/or modified CDS sequence (AUadapt) from InfluenzaA__ABJ16620__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcaacucgccccaccagauccuggacggcgagaacugcacccugaucgacgcccuccugggggacccccacugcgacggcuuccagaacaaggagugggaccuguucguggagcggaacaaggccuacagcaacugcuaccccuacgacgugccggacuacgcgucccuccgcucgcuggucgccuccagcggcacgcuggaguucaacaacgaguccuucaacuggaccgggguggcccagaacggcaccucguccgccugcaagcggcgcagcaucaaguccuucuucucgcggcucaacuggcugcaccagcugaaguacaaguaccccgcgcucaacgugaccaugcccaacaacgagaaguucgacaagcuguacaucuggggcguccaccaccccuccacggacagcgaccagaucucccuguacgcccaggccucggggcgcgugaccgugagcaccaagcggucccagcagaccgucaucccgaacaucgggucgcgccccugggugcggggcguguccagccgcaucuccaucuacuggacgaucgucaagcccggcgacauccuccugaucaacucgaccgggaaccugaucgcgccccggggcuacuucaagauccgcuccgggaaguccuccaucaugcggagcgacgccccgaucggcaagugcaacuccgagugcaucacccccaacggcucgauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacuccgaggggaccggccaggccgcggaccucaagagcacgcaggccgccaucaaccagaucaacgggaagcugaaccggcugaucgagaagaccaacaagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggguacaaggacuggauccucuggaucucguucgccaucagcugcuuccugcugugcgugguccuccugggcuucaucaugugggccugccagaagggcaacauccggugcaacaucugcaucuga

SEQ ID NO: 1627 - RNA, 1701 nt, Artificial Sequence
  derived and/or modified CDS sequence (AUadapt) from InfluenzaA__ABJ16631__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 1628 - RNA, 1698 nt, Artificial Sequence
  derived and/or modified CDS sequence (AUadapt) from InfluenzaA__ABJ16664__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggccacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagcggaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 1629 - RNA, 1698 nt, Artificial Sequence; identical to SEQ ID NO: 1449
  derived and/or modified CDS sequence (AUadapt) from InfluenzaA__ABJ16675__HA

SEQ ID NO: 1630 - RNA, 1698 nt, Artificial Sequence
  derived and/or modified CDS sequence (AUadapt) from InfluenzaA__ABJ16686__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacggucgccuccagccucgugcugcuggugucccucggggccaucagcuucuggaugugcuccaacggcagccugcagugccggaucugcaucuga

SEQ ID NO: 1631 - RNA, 1701 nt, Artificial Sequence
  derived and/or modified CDS sequence (AUadapt) from InfluenzaA__ABJ16697__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgacggacuccgaccagaucagccuguacgcccaggccccggggcgggugaccgugucgaccaagcgcucccagcagaccgucauccccaacaucggcagccggcccugggugcgcggcguguccucgcggaucuccaucuacuggacgaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgccgugcuccugggcuucaucaugugggcgugccagaaggggaacauccgcugcaacaucugcaucuga

SEQ ID NO: 1632 - RNA, 1701 nt, Artificial Sequence
  derived and/or modified CDS sequence (AUadapt) from InfluenzaA__ABJ16730__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagucgugguccuacaucgccgagacccccaaccccaagaacggcacgugcuaccccggcuacuucgccgacuacgaggagcuccgggagcagcugagcuccgugagcuccuucgagcgcuucgagaucuucccgaaggacagcuccuggcccaaccacaccgucaccaagggggugaccgccucgugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucucggugcucuccagccacuacucccgccgguucaccccggagaucgcccgccggcccaaggugcgcgaccaggagggccggaucaacuacuacuggacccugcuggagcccggggacaccaucaucuucgaggccaacggcaaccucaucgcccccugguacgccuucgcgcugagccgcggguucggcuccggcaucaucaucucgaacgccuccaugggggagugcgacgccaagugccagacgccgcagggcgccaucaacagcucccugcccuuccagaacguccaccccgugaccaucggggagugccccaaguacgugcggagcaccaagcuccgcauggucaccggccugcggaacgugccguccauccagagccgcgggcuguucggcgccaucgcgggcuucaucgagggcggguggacggggaugaucgacggcugguacggguaccaccaccagaacgagcagggcuccggcuacgccgccgaccagaaguccacccagaacgccaucaacgggaucaccaacaaggugaacucgaucaucgagaagaugaacacccaguucacggccgucggcaaggaguucaacaagcucgagcggcgcauggagaaccugaacaagaagguggacgacggguuccuggacaucuggaccuacaacgcggagcuccuggugcugcucgagaacgagcggacccuggacuuccacgacagcaacgucaagaaccuguacgagaaggugaagaaccagcucaagaacaacgccaaggagaucggcaacgggugcuucgaguucuaccacaagugcaacaacgagugcauggaguccgucaagaacggcaccuacgacuaccccaaguacagcaaggaguccaagcugaaccgcgagaagaucgacggcgugaagcuggagagcauggggguguaccagauccucgccaucuacucgacggucgccuccagccuggugcugcucgugucccugggcgccaucagcuucuggaugugcuccaacgggagccugcagugccggaucugcaucuga

SEQ ID NO: 1633 - RNA, 1701 nt, Artificial Sequence
  derived and/or modified CDS sequence (AUadapt) from InfluenzaA__ABJ16741__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccaacaagggcuucuucagccgccucaacuggcugcaccagcugaaguacaaguaccccgcgcucaacgugaccaugcccaacaacgagaaguucgacaagcuguacaucuggggcguccaccaccccuccacggacucggaccagaucucccuguacgcccaggccccggggcgggugaccgugagcaccaagcgcucgcagcagaccgucauccccaacaucggcucccggcccugggugcgcggggugagcuccaucaucucgaucuacuggacgaucgucaagcccggcgacauccuccugaucaacugcaccgggaaccugaucgccccgcggggcuacuucaagauccgcuccggcaagagcuccaucaugcggucggacgccuccaucgggaagugcaacagcgagugcaucacccccaacggcuccauccccaacgacaagcccuuccagaacgugaaccgcaucaccuacggggcgugcccgcgguacgugaagcagaacacgcucaagcuggccaccggcaugcgcaacguccccgagaagcagacccgggggaucuucggcgccaucgccggcuucaucgagaacgggugggagggcaugguggacgggugguacggcuuccgccaccagaacucggaggggaccggccaggccgcggaccugaaguccacgcaggccgccaucaaccagaucaacggcaagcucaaccggcugaucgggaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacauggggaacggcugcuucaagaucuaccacaagugcgacaacgccugcaucggguccauccggaacggcaccuacgaccacgacguguaccgcgacgaggcccugaacaaccgcuuccagaucaagggcgucgagcugaaguccggguacaaggacuggauccucuggaucuccuucgccaucagcugcuuccugcugugcgugguccuccugggcuucaucaugugggccugccagaaggggaacauccggugcaacaucugcaucuga

SEQ ID NO: 1634 - RNA, 1701 nt, Artificial Sequence
  derived and/or modified CDS sequence (AUadapt) from InfluenzaA__ABJ16752__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagcgggaucuccaucuacuggacgaucgucaagcccggcgacauccuccugaucaacugcaccgggaaccugaucgccccgcggggcuacuucaagauccgcucgggcaaguccagcaucaugcgguccgacgccucgaucgggaagugcaacuccgagugcaucacccccaacggcagcauccccaacgacaagcccuuccagaacgugaaccgcaucaccuacggggcgugcccgcgguacgugaagcagaacacgcucaagcuggccaccggcaugcgcaacguccccgagaagcagacccgggggaucuucggcgccaucgccggcuucaucgagaacgggugggagggcaugguggacgggugguacggcuuccgccaccagaacuccgaggggaccggccaggccgcggaccugaaguccacgcaggccgccaucaaccagaucaacggcaagcucaaccggcugaucgagaagaccaacgagaaguuccaccagaucgagaaggaguucuccgagguggaggggcgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgcuuccagaucaagggcgucgagcugaaguccggcuacaaggacuggauccucuggaucucguucgccaucagcugcuuccugcugugcgugguccuccugggguucaucaugugggccugccagaagggcaacauccggugcaacaucugcaucuga

SEQ ID NO: 1635 - RNA, 1701 nt, Artificial Sequence
  derived and/or modified CDS sequence (AUadapt) from InfluenzaA__ABJ16763__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcacugggugcgcggcguguccagccggaucuccaucuacuggacgaucgucaagcccggggacauccuccugaucaacugcaccggcaaccugaucgcgccccgcggguacuucaagauccggucgggcaaguccagcaucaugcgcuccgacgccucgaucggcaagugcaacuccgagugcaucaccccgaacgggagcauccccaacgacaagcccuuccagaacgugaaccggaucaccuacggcgccugcccccgcuacgugaagcagaacacgcucaagcuggccaccgggaugcggaacgucccggagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggccugccagaaggggaacauccgcugcaacaucugcaucuga

SEQ ID NO: 1636 - RNA, 1701 nt, Artificial Sequence
  derived and/or modified CDS sequence (AUadapt) from InfluenzaA__ABJ16774__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcucccccaccggccgcaucugcgacucgccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcucgcugguggccuccagcggcacccuggaguucaacaacgaguccuucaacuggaccggcguggcccagaacgggaccucguccgccugcaagcggcgcagcaucaaguccuucuucucgcggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggccucggggcgcgugaccgucagcaccaagcggucccagcagacggugauccccaacaucggcucggggcccugggugcgcggcgucuccagccggaucuccaucuacuggaccaucgugaagcccggcgacauccuccugaucaacucgaccgggaaccugaucgccccgcgcggcuacuucaagauccggaacgggaaguccagcaucaugcgcuccaacacccccaucggcaagugcaacucggagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaccggccaggccgccgaccugaaguccacccaggcggccaucaaccagaucaacgggaagcucaaccgccugaucgagaagaccaacgagaaguuccaccagaucgagaaggaguucucggaggucgagggccggauccaggaccuggagaaguacguggaggacacgaagaucgaccucugguccuacaacgccgagcugcugguggcccucgagaaccagcacaccaucgaccugaccgacagcgagaugaacaagcuguucgagcgcacccggaagcagcuccgcgagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcucaagucgggguacaaggacuggauccuguggaucuccuucgccaucagcugcuuccugcugugcgucgugcuccugggcuucaucaugugggccugccagaagggcaacauccggugcaacaucugcaucuga

SEQ ID NO: 1637 - RNA, 1701 nt, Artificial Sequence
  derived and/or modified CDS sequence (AUadapt) from InfluenzaA__ABJ16785__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccuacgccugcaagcgccggucgaacaaguccuucuucagccgccucaacuggcugcaccagcugaaguacaaguaccccgcgcucaacgugaccaugcccaacaacgagaaguucgacaagcuguacaucuggggcguccaccaccccuccacggacucggaccagaucucccuguacgcccaggccccggggcgggugaccgugagcaccaagcgcucgcagcagaccgucauccccaacaucggcucccggcccugggugcgcggcgugagcucccggaucucgaucuacuggacgaucgucaagcccggggacauccuccugaucaacugcaccggcaaccugaucgccccgcgcggguacuucaagauccgguccggcaagagcuccaucaugcgcucggacgccuccaucggcaagugcaacagcgagugcaucacccccaacggguccauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacucggagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucuccuucgccaucagcugcuuccugcugugcgugguccuccugggcuucaucaugugggccugccagaaggggaacauccgcugcaacaucugcaucuga

SEQ ID NO: 1638 - RNA, 1701 nt, Artificial Sequence; identical to SEQ ID NO: 1155
  derived and/or modified CDS sequence (AUadapt) from InfluenzaA__ABJ53438__HA

SEQ ID NO: 1639 - RNA, 1698 nt, Artificial Sequence; identical to SEQ ID NO: 987
  derived and/or modified CDS sequence (AUadapt) from InfluenzaA__ABJ53449__HA

SEQ ID NO: 1640 - RNA, 1701 nt, Artificial Sequence
  derived and/or modified CDS sequence (AUadapt) from InfluenzaA__ABJ53471__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccucguccgggacgcucgaguucaacaacgagagcuucaacuggaccggcgugacccagaacgggaccuccucggccugcaagcgcggcuccaacaacucguucuucucccggcugaacuggcugacgcaccucaaguucaaguaccccgcccugaacgugaccaugcccaacaacgagaaguucgacaagcuguacaucuggggcguccaccaccccgggaccgacaacgaccagaucuuccucuacgcgcaggccagcggccgcaucaccguguccacgaagcggucgcagcagaccgugaucccgaacaucgggagccgcccccggguccgcaacauccccucccggaucucgaucuacuggaccaucgugaagcccggcgacauccugcugaucaacuccaccgggaaccucaucgccccgcgcggcuacuucaagauccggagcggcaaguccucgaucaugcgcuccgacgcccccaucgggaagugcaacucggagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucaaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaagggcguggagcucaagucgggguacaaggacuggauccuguggaucuccuucgccaucagcugcuuccugcucugcguggcccugcugggcuucaucaugugggccugccagaaggggaacauccgcugcaacaucugcaucuga

SEQ ID NO: 1641 - RNA, 1701 nt, Artificial Sequence
  derived and/or modified CDS sequence (AUadapt) from InfluenzaA__ABJ53482__HA
augaagaccaucaucgcccugucguacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgucgcugcgcucccucgucgccagcuccggcacgcuggaguucaacaacgagucguucaacuggaccggggugacccagaacggcaccuccucggccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucaaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 1642 - RNA, 1698 nt, Artificial Sequence; identical to SEQ ID NO: 1477
  derived and/or modified CDS sequence (AUadapt) from InfluenzaA__ABJ53493__HA

SEQ ID NO: 1643 - RNA, 1698 nt, Artificial Sequence
  derived and/or modified CDS sequence (AUadapt) from InfluenzaA__ABJ53504__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcucgcacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccacacggagaacgccuacgucuccguggugagcucccacuacagccgccgguucaccccggagaucgccaagcgccccaagguccgggaccaggagggccgcaucaacuacuacuggacccugcuggagcccggcgacaccaucaucuucgaggcgaacgggaaccucaucgcccccugguacgccuucgcccugucccggggcuucgagagcgggaucaucacguccaacgccccgaugaacgagugcgacgcgaagugccagacgccccugggcgccaucaacagcucccuccccuuccagaacgugcaccccgugaccaucggcgagugcccgaaguacguccgcagcgccaagcugcggauggugaccgggcugcgcaacauccccuccauccagucgcggggccucuucggggccaucgccggcuucaucgagggcggguggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccugaacaagaaggucgacgacggcuuccucgacaucuggaccuacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcugaaccgggagaagaucgacggcgugaagcucgagagcaugggggucuaccagauccuggccaucuacuccacgguggccagcucccuggugcuccuggucagccugggcgccaucuccuucuggaugugcagcaacggcucccuccagugccgcaucugcaucuga

SEQ ID NO: 1644 - RNA, 1701 nt, Artificial Sequence; identical to SEQ ID NO: 1632
  derived and/or modified CDS sequence (AUadapt) from InfluenzaA__ABJ53515__HA

SEQ ID NO: 1645 - RNA, 1701 nt, Artificial Sequence
  derived and/or modified CDS sequence (AUadapt) from InfluenzaA__ABK39962__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaagacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucucguucgccaucagcugcuuccugcugugcaucgugcuccugggcuucaucaugugggccugccagaaggggaacauccggugcaacaucugcaucuga

SEQ ID NO: 1646 - RNA, 1701 nt, Artificial Sequence; identical to SEQ ID NO: 875
  derived and/or modified CDS sequence (AUadapt) from InfluenzaA__ABK39973__HA

SEQ ID NO: 1647 - RNA, 1701 nt, Artificial Sequence
  derived and/or modified CDS sequence (AUadapt) from InfluenzaA__ABK39984__HA
augaagaccaucaucgcccugucguacauccucugccugguguucgcccagaagcugcccggcaacgacaacucccgcgcgacccucugccuggggcaccacgccgucccgaacggcacgaucgugaagaccaucaccaacgaccagaucgaggugaccaacgccacggagcugguccagucguccagcaccgggggcaucugcgacucgccccaccagauccucgacggggagaacugcacccugaucgacgcccugcucggcgacccccagugcgacggcuuccagaacaagaagugggaccuguucguggagcggagcaaggccuacuccaacugcuaccccuacgacgugccggacuacgcgucgcugcgcucccucgucgccagcuccgggacccuggaguucaacaacgagucguucaacuggacgggcgugacccagaacgggaccuccucggccugcaagcggcgcuccaacaacagcuucuucucccggcugaacuggcucacccaccugaaguucaaguaccccgcccugaacgugacgaugcccaacaacgagaaguucgacaagcucuacaucuggggcguccaccaccccgggaccgacaacgaccagaucuuccuguacgcgcaggccucgggccgcaucaccguguccaccaagcggagccagcagacggugaucccgaacaucggcucgcgcccccggguccgcaacauccccucccggaucagcaucuacuggaccaucgugaagcccggggacauccugcucaucaacuccaccggcaaccugaucgccccgcgcggguacuucaagauccggucgggcaaguccucgaucaugcgcuccgacgcccccaucggcaagugcaacagcgagugcaucacccccaacggguccauccccaacgacaagccguuccagaacgugaaccggaucacguacggcgccugcccccgcuacgucaagcagaacacccugaagcucgcgaccgggaugcggaacgugcccgagaagcagacccgcggcaucuucggggccaucgccggcuucaucgagaacggcugggaggggaugguggacggcugguacggguuccggcaccagaacucggagggcaucgggcaggccgccgaccugaaguccacgcaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacaccaucgaccucacggacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 1648 - RNA, 1698 nt, Artificial Sequence
  derived and/or modified CDS sequence (AUadapt) from InfluenzaA__ABK39995__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguacuccuucgagcgguucgagaucuucccgaaggagucguccuggcccaaccacacggugaccggggucagcgccuccugcagccacaacggcaaguccagcuucuaccgcaaccugcuguggcucaccgggaagaacggccuguaccccaaccuguccaagagcuacgccaacaacaaggagaaggaggugcucauccuguggggcgugcaccacccgcccaacaucgggaaccagcggacccuguaccacacggagaacgccuacgucuccguggugucgagccacuacucccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucagccggggguucggcuccggcaucaucaccagcaacgcccccauggacgagugcgacgccaagugccagacgccccagggggcgaucaacuccagccugcccuuccagaacgugcacccggugaccaucggcgagugccccaaguacguccgcuccgccaagcugcggauggugaccgggcuccgcaacauccccucgauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgucaagaaccuguacgagaaggucaagagccagcugaagaacaacgccaaggagaucgggaacggcugcuucgaguucuaccacaagugcaacaacgagugcauggaguccgugaagaacgggacguacgacuaccccaaguacagcgaggaguccaagcucaaccgggagaagaucgacggcgugaagcuggacucgaugggcguguaccagauccuggcgaucuacuccaccguggccagcagccucguccugcuggugucccucggggccaucagcuucuggaugugcuccaacggcagccugcagugccgcaucugcaucuga

SEQ ID NO: 1649 - RNA, 1701 nt, Artificial Sequence
  derived and/or modified CDS sequence (AUadapt) from InfluenzaA__ABK40017__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacaagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 1650 - RNA, 1701 nt, Artificial Sequence
  derived and/or modified CDS sequence (AUadapt) from InfluenzaA__ABK40028__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagucgugguccuacaucgccgagacccccaaccccaagaacggcacgugcuaccccggcuacuucgccgacuacgaggagcuccgggagcagcugagcuccgugagcuccuucgagcgcuucgagaucuucccgaaggacagcuccuggcccaaccacaccgucaccaagggggugaccgccucgugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccucgaacaugggggaccagcgggccaucuaccacaaggagaacgcguacgucaccgugcucagcucccacuacagccgccgguucaccccggagaucgcccgccggcccaaggugcgcgaccaggagggccggaucaacuacuacuggacccugcuggagcccggggacacgaucaucuucgaggccaacggcaaccucaucgcccccugguacgccuucgcgcugucccgcggguucggcagcggcaucaucaucuccaacgccucgaugggggagugcgacgccaagugccagaccccgcagggcgccaucaacuccagccugcccuuccagaacguccaccccgugaccaucggggagugccccaaguacgugcgguccaccaagcuccgcauggucacgggccugcggaacgugccgagcauccagucccgcgggcuguucggcgccaucgcgggcuucaucgagggcggguggaccgggaugaucgacggcugguacggguaccaccaccagaacgagcagggcucgggcuacgccgccgaccagaaguccacccagaacgccaucaacgggaucaccaacaaggugaacagcaucaucgagaagaugaacacgcaguucaccgccgucggcaaggaguucaacaagcucgagcggcgcauggagaaccugaacaagaagguggacgacggguuccuggacaucuggaccuacaacgcggagcuccuggugcugcucgagaacgagcggacccuggacuuccacgacuccaacgucaagaaccuguacgagaaggugaagaaccagcucaagaacaacgccaaggagaucggcaacgggugcuucgaguucuaccacaagugcaacaacgagugcauggagagcgucaagaacggcacguacgacuaccccaaguacuccaaggagagcaagcugaaccgcgagaagaucgacggcgugaagcuggaguccauggggguguaccagauccucgccaucuacucgaccgucgccagcucccuggugcugcucgugagccugggcgccaucuccuucuggaugugcagcaacgggucccugcagugccggaucugcaucuga

SEQ ID NO: 1651 - RNA, 1701 nt, Artificial Sequence; identical to SEQ ID NO: 1632
  derived and/or modified CDS sequence (AUadapt) from InfluenzaA__ABK40039__HA

SEQ ID NO: 1652 - RNA, 1701 nt, Artificial Sequence; identical to SEQ ID NO: 1632
  derived and/or modified CDS sequence (AUadapt) from InfluenzaA__ABK40050__HA

SEQ ID NO: 1653 - RNA, 1701 nt, Artificial Sequence; identical to SEQ ID NO: 895
  derived and/or modified CDS sequence (AUadapt) from InfluenzaA__ABK40061__HA

SEQ ID NO: 1654 - RNA, 1701 nt, Artificial Sequence; identical to SEQ ID NO: 895
  derived and/or modified CDS sequence (AUadapt) from InfluenzaA__ABK40075__HA

SEQ ID NO: 1655 - RNA, 1701 nt, Artificial Sequence; identical to SEQ ID NO: 1166
  derived and/or modified CDS sequence (AUadapt) from InfluenzaA__ABK40510__HA

SEQ ID NO: 1656 - RNA, 1701 nt, Artificial Sequence; identical to SEQ ID NO: 1166
  derived and/or modified CDS sequence (AUadapt) from InfluenzaA__ABK40534__HA

SEQ ID NO: 1657 - RNA, 1701 nt, Artificial Sequence
  derived and/or modified CDS sequence (AUadapt) from InfluenzaA__ABK40546__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaacaagucgugguccuacaucgccgagacccccaacagcgagaacgggaccugcuaccccggcuacuucgccgacuacgaggagcugcgcgagcagcuguccagcguguccucguucgagcgguucgagaucuuccccaaggaguccagcuggccgaagcacaacgucaccaagggggugacggccuccugcagccacaagggcaaguccucguucuaccgcaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucucggugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgucgauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggucgggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacucggaggagagcaagcucaaccgcgagaagaucgacggcgugaagcuggaguccauggggguguaccagauccuggccaucuacagcaccgucgccuccucgcucgugcugcuggugucccucggcgccaucagcuucuggaugugcuccaacggcagccugcagugccggaucugcaucuga

SEQ ID NO: 1658 - RNA, 1701 nt, Artificial Sequence; identical to SEQ ID NO: 1166
  derived and/or modified CDS sequence (AUadapt) from InfluenzaA__ABK40557__HA

SEQ ID NO: 1659 - RNA, 1701 nt, Artificial Sequence; identical to SEQ ID NO: 1166
  derived and/or modified CDS sequence (AUadapt) from InfluenzaA__ABK40568__HA

SEQ ID NO: 1660 - RNA, 1701 nt, Artificial Sequence; identical to SEQ ID NO: 1166
  derived and/or modified CDS sequence (AUadapt) from InfluenzaA__ABK40579__HA

SEQ ID NO: 1661 - RNA, 1701 nt, Artificial Sequence
  derived and/or modified CDS sequence (AUadapt) from InfluenzaA__ABK40590__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagucgcucuucuccaagaaguccuggagcuacaucgccgagacccccaacagcgagaacgggaccugcuaccccggcuacuucgccgacuacgaggagcugcgcgagcagcuguccucgguguccagcuucgagcgguucgagaucuuccccaaggaguccagcuggccgaagcacaacgucaccaagggggugacggccuccugcucgcacaagggcaaguccagcuucuaccgcaaccuccuguggcugaccgagaagaacggguccuaccccaaccucagcaagucguacgugaacaacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcucggggaucaucaccuccaacgcgagcauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccucgauccagucccggggccuguucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggugaagaaccagcugaagaacaacgcgaaggagaucgggaacggcugcuucgaguucuaccacaagugcaacaacgagugcauggagucggucaagaacgggaccuacgacuacccgaaguacuccgaggagagcaagcucaaccgcgagaagaucgacggcgugaagcuggagagcauggggguguaccagauccuggccaucuacuccaccgucgccucgucccucgugcugcuggugagccucggcgccaucuccuucuggaugugcagcaacggcucccugcagugccggaucugcaucuga

SEQ ID NO: 1662 - RNA, 1701 nt, Artificial Sequence; identical to SEQ ID NO: 1166
  derived and/or modified CDS sequence (AUadapt) from InfluenzaA__ABK40601__HA

SEQ ID NO: 1663 - RNA, 1701 nt, Artificial Sequence; identical to SEQ ID NO: 895
  derived and/or modified CDS sequence (AUadapt) from InfluenzaA__ABK40612__HA

SEQ ID NO: 1664 - RNA, 1701 nt, Artificial Sequence
  derived and/or modified CDS sequence (AUadapt) from InfluenzaA__ABK40623__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcgguccacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucgccuacggcgccugcccgcgguacgucaagcagaacacgcucaagcuggccaccgggaugcgcaacgugcccgagaagcagacccggggcaucuucggggccaucgccggcuucaucgagaacgggugggagggcaugguggacggcugguacggguuccgccaccugaacagcgagggcaccgggcaggcggccgaccucaaguccacgcaggccgccaucaaccagaucaacggcaagcugaaccggcugaucgagaagaccaacgagaaguuccaccagaucgagaaggaguucagcgaggucgaggggcgcauccaggaccucgagaaguacgugaaggacaccaagaucgaccugugguccuacaacgccgagcugcucguggcgcuggagaaccagcacaccaucgaccugacggacucggagaugaacaagcuguucgagcggacccgcaagcagcuccgcgagaacgccgaggacgucggcaacggcugcuucaagaucuaccacaagugcgacaacgccugcaucggguccauccggaacggcaccuacgaccacgacguguaccgcgacgaggcccugaacaaccgguuccagaucaagggggucgagcucaagagcggcuacaaggacuggauccuguggaucagcuucgccaucuccugcuuccugcucugcguggugcugcugggguucaucaugugggcgugccagaagggcaacauccgcugcaacaucugcaucuga

SEQ ID NO: 1665 - RNA, 1701 nt, Artificial Sequence; identical to SEQ ID NO: 1229
  derived and/or modified CDS sequence (AUadapt) from InfluenzaA__ABK40645__HA

SEQ ID NO: 1666 - RNA, 1701 nt, Artificial Sequence
  derived and/or modified CDS sequence (AUadapt) from InfluenzaA__ABK40656__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacucgccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggucgcuggucgccuccagcggcacgcuggaguucaccaacgagaacuucaacuggaccgggguggcccaggacggcaaguccuacucgugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccacccgucgacggacuccgaccagaccagccuguacgugcgcgcguccgggaaggucaccgugucgaccaagcggagccagcagacggugauccccgacaucggcuaccgccccuggguccgggggcucuccucgcgcaucuccaucuacuggaccaucgugaagcccggcgacauccugcugaucaacagcaccgggaaccucaucgccccgcggggcuacuucaagauccgcaacggcaaguccucgaucaugcgguccgacgcccccaucgggaacugcagcuccgagugcaucacccccaacggcucgauccccaacgacaagccguuccagaacgugaaccgcaucacguacgggaccugcccccgguacgucaagcagaacacccugaagcuggccaccggcaugcgcaacgugcccgagaagcagacgcgggggaucuucggcgccaucgcgggcuucaucgagaacgggugggagggcaugguggacgggugguacggcuuccgccaccagaacuccgaggggaccggccaggccgccgaccucaagagcacccaggccgccaucgaccagaucaacggcaagcugaaccggcuggucgagaagaccaacgagaaguuccaccagaucgagaaggaguucuccgagguggaggggcgcauccaggaccucgagaaguacguggaggacacgaagaucgaccuguggucguacaacgcggagcugcucgucgcccuggagaaccagcacaccaucgaccugaccgacuccgagaugaacaagcuguucgagcggacccgcaagcagcuccgcgagaacgccgaggacaugggcaacgggugcuucaagaucuaccacaagugcgacaacgccugcaucggcagcauccggaacgggacguacgaccacgacguguaccgcgacgaggcccugaacaaccgguuccagaucaagggcgucgagcucaaguccggcuacaaggacuggauccuguggaucagcuucgcgaucuccugcuuccugcucugcguggugcugcugggguucaucaugugggccugccagaagggcaacauccgcugcaacaucugcaucuga

SEQ ID NO: 1667 - RNA, 1701 nt, Artificial Sequence
  derived and/or modified CDS sequence (AUadapt) from InfluenzaA__ABK40667__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgagggguucaacuggaccggcguggcccaggacgggaaguccuacgccugcaagcgcggcuccgugaacucguucuucucccggcucaacuggcugcacaagcuggaguacaaguaccccgcgcucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagcuccgcaacggcaagucguccaucaugcggucggacgccccgaucgacaacugcaacuccgagugcaucacccccaacgggagcauccccaacgacaagcccuuccagaacgugaaccgcaucacguacggcgccugcccgcgguacgucaagcagaacacccugaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagucgacccaggcggccaucgaccagaucaacggcaagcugaaccggcugaccgagaagaccaacgagaaguuccaccagaucgagaaggaguucuccgaggucgagggccgcauccaggaccucgagaaguacguggaggacacgaagaucgaccuguggagcuacaacgccgagcugcucguggcccuggagaaccagcacaccaucgaccugaccgacuccgagaugaacaagcuguucgagcggacccgcaagcagcuccgcgagaacgccgaggacauggggaacggcugcuucaagaucuaccacaagugcgacaacgcgugcaucgggucgauccggaacggcacguacaaccacgacgucuaccgcgacgaggcccugaacaaccgguuccagaucaaggggguggagcucaaguccggcuacaaggacuggauccuguggaucagcuucgccaucuccugcuuccugcucugcgucgugcugcugggcuucaucaugugggccugccagaaggggaacauccgcugcaacaucugcaucuga

SEQ ID NO: 1668 - RNA, 1701 nt, Artificial Sequence; identical to SEQ ID NO: 1311
  derived and/or modified CDS sequence (AUadapt) from InfluenzaA__ABK40678__HA

SEQ ID NO: 1669 - RNA, 1698 nt, Artificial Sequence
  derived and/or modified CDS sequence (AUadapt) from InfluenzaA__ABK40689__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacggucgccuccagccucgugcugcuggugucccucggggccaucagcuucuggaugugcuccaacggcagccugcagugccggaucugcaucuga

SEQ ID NO: 1670 - RNA, 1701 nt, Artificial Sequence; identical to SEQ ID NO: 895
  derived and/or modified CDS sequence (AUadapt) from InfluenzaA__ABK40700__HA

SEQ ID NO: 1671 - RNA, 1701 nt, Artificial Sequence; identical to SEQ ID NO: 895
  derived and/or modified CDS sequence (AUadapt) from InfluenzaA__ABK40711__HA

SEQ ID NO: 1672 - RNA, 1701 nt, Artificial Sequence
  derived and/or modified CDS sequence (AUadapt) from InfluenzaA__ABK40722__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacaacgaccagaucucccuguacgcccaggccccggggcgggugaccgugucgaccaagcgcucgcagcagaccgucauccccaacaucggcucccggcccugggugcgcggcgugagcucccggaucucgaucuacuggacgaucgucaagcccggggacauccuccugaucaacugcaccggcaaccugaucgccccgcgcggguacuucaagauccgguccggcaagagcuccaucaugcgcucggacgccuccaucggcaagugcaacagcgagugcaucacccccaacggguccauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacucggagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucuccuucgccaucagcugcuuccugcugugcgugguccuccugggcuucaucaugugggccugccagaaggggaacauccgcugcaacaucugcaucuga

SEQ ID NO: 1673 - RNA, 1701 nt, Artificial Sequence; identical to SEQ ID NO: 895
  derived and/or modified CDS sequence (AUadapt) from InfluenzaA__ABK40733__HA

SEQ ID NO: 1674 - RNA, 1701 nt, Artificial Sequence; identical to SEQ ID NO: 1550
  derived and/or modified CDS sequence (AUadapt) from InfluenzaA__ABK40744__HA

SEQ ID NO: 1675 - RNA, 1701 nt, Artificial Sequence; identical to SEQ ID NO: 1160
  derived and/or modified CDS sequence (AUadapt) from InfluenzaA__ABK79948__HA

SEQ ID NO: 1676 - RNA, 1698 nt, Artificial Sequence; identical to SEQ ID NO: 1449
  derived and/or modified CDS sequence (AUadapt) from InfluenzaA__ABK79959__HA

SEQ ID NO: 1677 - RNA, 1701 nt, Artificial Sequence
  derived and/or modified CDS sequence (AUadapt) from InfluenzaA__ABK79970__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaagaaguccuggucguacaucgccgagacccccaaccccaagaacggcacgugcuaccccggcuacuucgccgacuacgaggagcuccgggagcagcugagcuccgugagcuccuucgagcgcuucgagaucuucccgaaggacagcuccuggcccaaccacaccgucaccaagggggugaccgccucgugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucucggugcucuccagccacuacucccgccgguucaccccggagaucgcccgccggcccaaggugcgcgaccaggagggccggaucaacuacuacuggacccugcuggagcccggggacaccaucaucuucgaggccaacggcaaccucaucgcccccugguacgccuucgcgcugagccgcggguucggcuccggcaucaucaucucgaacgccuccaugggggagugcgacgccaagugccagacgccgcagggcgccaucaacagcucccugcccuuccagaacguccaccccgugaccaucggggagugccccaaguacgugcggagcaccaagcuccgcauggucaccggccugcggaacgugccguccauccagagccgcgggcuguucggcgccaucgcgggcuucaucgagggcggguggacggggaugaucgacggcugguacggguaccaccaccagaacgagcagggcuccggcuacgccgccgaccagaaguccacccagaacgccaucaacgggaucaccaacaaggugaacucgaucaucgagaagaugaacacccaguucacggccgucggcaaggaguucaacaagcucgagcggcgcauggagaaccugaacaagaagguggacgacggguuccuggacaucuggaccuacaacgcggagcuccuggugcugcucgagaacgagcggacccuggacuuccacgacagcaacgucaagaaccuguacgagaaggugaagaaccagcucaagaacaacgccaaggagaucggcaacgggugcuucgaguucuaccacaagugcaacaacgagugcauggaguccgucaagaacggcaccuacgacuaccccaaguacagcaaggaguccaagcugaaccgcgagaagaucgacggcgugaagcuggagagcauggggguguaccagauccucgccaucuacucgacggucgccuccagccuggugcugcucgugucccugggcgccaucagcuucuggaugugcuccaacgggagccugcagugccggaucugcaucuga

SEQ ID NO: 1678 - RNA, 1701 nt, Artificial Sequence
  derived and/or modified CDS sequence (AUadapt) from InfluenzaA__ABK79981__HA
augaagaccaucaucgcccugucguacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagucguccagcaccgggggcaucugcgacucgccccaccagauccuggacggggagaacugcacgcugaucgacgcccuccugggcgacccccacugcgacggcuuccagaacaaggagugggaccuguucguggagcgcagcaaggccuacuccaacugcuaccccuacgacgugccggacuacgccucgcuccggucccuggucgcgagcuccgggacccuggaguucaacaacgagucguucaacuggaccggcguggcccagaacgggaccuccagcgccugcaagcgccgguccaacaagucguucuucucccgccucaacuggcugcaccagcugaaguacaaguaccccgcccucaacgugacgaugcccaacaacgagaaguucgacaagcuguacaucuggggcguccaccaccccagcaccgacuccgaccagaucucgcuguacgcgcaggccccggggcgggugaccgugagcaccaagcgcucccagcagacggucauccccaacaucggcucgcggcccugggugcgcggcguguccagccggaucuccaucuacuggaccaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucacguacggcgccugcccgcgcuacgugaagcagaacacccucaagcuggcgaccgggaugcggaacguccccgagaagcagacccgcggcaucuucggggccaucgccggcuucaucgagaacggcugggaggggaugguggacggcugguacggguuccggcaccagaacuccgagggcacggggcaggccgccgaccugaaguccacccaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacacgaucgaccugaccgacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggccugccagaaggggaacauccgcugcaacaucugcaucuga

SEQ ID NO: 1679 - RNA, 1701 nt, Artificial Sequence; identical to SEQ ID NO: 895
  derived and/or modified CDS sequence (AUadapt) from InfluenzaA__ABK79992__HA

SEQ ID NO: 1680 - RNA, 1701 nt, Artificial Sequence; identical to SEQ ID NO: 1166
  derived and/or modified CDS sequence (AUadapt) from InfluenzaA__ABK80025__HA

SEQ ID NO: 1681 - RNA, 1701 nt, Artificial Sequence; identical to SEQ ID NO: 1166
  derived and/or modified CDS sequence (AUadapt) from InfluenzaA__ABK80036__HA

SEQ ID NO: 1682 - RNA, 1701 nt, Artificial Sequence; identical to SEQ ID NO: 1166
  derived and/or modified CDS sequence (AUadapt) from InfluenzaA__ABK80047__HA

SEQ ID NO: 1683 - RNA, 1701 nt, Artificial Sequence; identical to SEQ ID NO: 1011
  derived and/or modified CDS sequence (AUadapt) from InfluenzaA__ABK80058__HA

SEQ ID NO: 1684 - RNA, 1701 nt, Artificial Sequence
  derived and/or modified CDS sequence (AUadapt) from InfluenzaA__ABK80069__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcgguccacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccuggauccgcggggugagcucccggaucagcaucuacuggaccaucgucaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucgccuacggcgccugcccgcgguacgugaagcagaacacgcucaagcuggccaccgggaugcgcaacguccccgagaagcagacccggggcaucuucggggccaucgccggcuucaucgagaacgggugggagggcaugguggacggcugguacggguuccgccaccugaacagcgagggcaccgggcaggcggccgaccucaaguccacgcaggccgccaucaaccagaucaacggcaagcugaaccggcugaucgagaagaccaacgagaaguuccaccagaucgagaaggaguucagcgagguggaggggcgcauccaggaccucgagaaguacgucgaggacaccaagaucgaccugugguccuacaacgccgagcugcucguggcgcuggagaaccagcacaccaucgaccugacggacucggagaugaacaagcuguucgagcggacccgcaagcagcuccgcgagaacgccgaggacgugggcaacggcugcuucaagaucuaccacaagugcgacaacgccugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcucugcgucgugcugcugggguucaucaugugggcgugccagaagggcaacauccgcugcaacaucugcaucuga

SEQ ID NO: 1685 - RNA, 1701 nt, Artificial Sequence
  derived and/or modified CDS sequence (AUadapt) from InfluenzaA__ABK80080__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcgguccacggccuacuccaacugcuaccccuacgacgucccggacuacgcgucgcuccgcucccugguggccagcuccggcacccuggaguucaacaacgagucguucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucucgaucuacuggaccaucgugaagcccggcgacauccuccugaucaacuccaccggcaaccugaucgcgccccggggguacuucaagauccgcagcggcaaguccucgaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacucggagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacucggagaugaacaagcuguucgagcggacccgcaagcagcuccgcgagaacgcggaggacaugggcaacggcugccugaagaucuaccacaagugcgacaacgccugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 1686 - RNA, 1701 nt, Artificial Sequence; identical to SEQ ID NO: 895
  derived and/or modified CDS sequence (AUadapt) from InfluenzaA__ABK80091__HA

SEQ ID NO: 1687 - RNA, 1701 nt, Artificial Sequence; identical to SEQ ID NO: 895
  derived and/or modified CDS sequence (AUadapt) from InfluenzaA__ABK80102__HA

SEQ ID NO: 1688 - RNA, 1701 nt, Artificial Sequence; identical to SEQ ID NO: 296
  derived and/or modified CDS sequence (AUadapt) from InfluenzaA__ABK80113__HA

SEQ ID NO: 1689 - RNA, 1701 nt, Artificial Sequence
  derived and/or modified CDS sequence (AUadapt) from InfluenzaA__ABK80124__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaagaacuggauccucuggaucucguucgccaucagcugcuuccugcugugcaucgugcuccugggcuucaucaugugggccugccagaaggggaacauccggugcaacaucugcaucuga

SEQ ID NO: 1690 - RNA, 1701 nt, Artificial Sequence; identical to SEQ ID NO: 296
  derived and/or modified CDS sequence (AUadapt) from InfluenzaA__ABK80135__HA

SEQ ID NO: 1691 - RNA, 1701 nt, Artificial Sequence; identical to SEQ ID NO: 296
  derived and/or modified CDS sequence (AUadapt) from InfluenzaA__ABK80146__HA

SEQ ID NO: 1692 - RNA, 1701 nt, Artificial Sequence; identical to SEQ ID NO: 296
  derived and/or modified CDS sequence (AUadapt) from InfluenzaA__ABK80157__HA

SEQ ID NO: 1693 - RNA, 1701 nt, Artificial Sequence; identical to SEQ ID NO: 807
  derived and/or modified CDS sequence (AUadapt) from InfluenzaA__ABK80168__HA

SEQ ID NO: 1694 - RNA, 1701 nt, Artificial Sequence
  derived and/or modified CDS sequence (AUadapt) from InfluenzaA__ABK80179__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcgugcccaacgacaagcccuuccagaacgucaaccgcaucaccuacggcgccugcccgcgguacgugaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgccugcagaucaaggggguggagcucaaguccggcuacaaggacuggauccuguggaucucguucgccaucagcugcuuccugcucugcaucguccugcugggcuucaucaugugggccugccagaaggggaacauccggugcaacaucugcaucuga

SEQ ID NO: 1695 - RNA, 1701 nt, Artificial Sequence; identical to SEQ ID NO: 807
  derived and/or modified CDS sequence (AUadapt) from InfluenzaA__ABK80190__HA

SEQ ID NO: 1696 - RNA, 1701 nt, Artificial Sequence; identical to SEQ ID NO: 1550
  derived and/or modified CDS sequence (AUadapt) from InfluenzaA__ABK80201__HA

SEQ ID NO: 1697 - RNA, 1701 nt, Artificial Sequence
  derived and/or modified CDS sequence (AUadapt) from InfluenzaA__ABK80212__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaagaacuggauccuguggaucucguucgccaucagcugcuuccuccugugcgucgcccugcucggguucaucaugugggccugccagaagggcaacauccggugcaacaucugcaucuga

SEQ ID NO: 1698 - RNA, 1701 nt, Artificial Sequence; identical to SEQ ID NO: 761
  derived and/or modified CDS sequence (AUadapt) from InfluenzaA__ABK80223__HA

SEQ ID NO: 1699 - RNA, 1701 nt, Artificial Sequence
  derived and/or modified CDS sequence (AUadapt) from InfluenzaA__ABK80234__HA
augcgcaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcggucgaaggccuacuccaacugcuaccccuacgacgugccggaccacgcgucgcugcgcucccucgucgccagcuccgggacgcuggaguucaacaacgagucguucgacuggaccggcgugacccagaacgggaccuccucggccugcaagcggcgcuccaacaagagcuucuucucccggcugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccgcaucaccgugucgacgaagcggucccagcagaccgugaucccgaacaucggcagccgcccccggguccgcgacguguccucgcggaucuccaucuacuggaccaucgugaagcccggggacauccugcucaucaacucgaccggcaaccugaucgcgccccgcggguacuucaagauccgguccggcaagagcuccaucaugcgcucggacgccccgaucggcaagugcaacuccgagugcaucacgcccaacgggucgauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcucgauccggaacgggacguacgaccacgacguguaccgcgacgaggcccucaacaaccgguuccagaucaagggcguggagcugaaguccggcuacaaggacuggauccuguggaucucguucgccaucagcugcuuccuccugugcgucgcccugcucggguucaucaugugggccugccagaagggcaacauccgcugcaacaucugcaucuga

SEQ ID NO: 1700 - RNA, 1701 nt, Artificial Sequence
  derived and/or modified CDS sequence (AUadapt) from InfluenzaA__ABK80245__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggcccacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaaccagucguucuucucccgccugaacuggcucacgcaccugaaguucaaguaccccgcccugaacgugaccaugcccaacaacgagaaguucgacaagcucuacaucuggggcgugcaccaccccgggaccgacagcgaccagaucucccuguacgcgcaggccccgggccggaucaccgucucgacgaagcgcucgcagcagaccgugauccccaacaucggcucccggccccgcgugcgggacaucucgucccgcaucagcaucuacuggaccaucgucaagcccggggacauccugcucaucaacuccaccggcaaccugaucgccccgcggggguacuucaagauccgcucgggcaaguccucgaucaugaaguccgacgcccccaucggcaagugcaacucggagugcaucacgcccaacggguccauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcgucgagcugaaguccggcuacaaggacuggauccuguggaucuccuucgccaucagcugccuccugcugugcguggcccuccugggguucaucaugugggccugccagaagggcaacauccgcugcaacaucugcaucuga

SEQ ID NO: 1701 - RNA, 1701 nt, Artificial Sequence; identical to SEQ ID NO: 1700
  derived and/or modified CDS sequence (AUadapt) from InfluenzaA__ABK80256__HA

SEQ ID NO: 1702 - RNA, 1701 nt, Artificial Sequence; identical to SEQ ID NO: 857
  derived and/or modified CDS sequence (AUadapt) from InfluenzaA__ABK80267__HA

SEQ ID NO: 1703 - RNA, 1701 nt, Artificial Sequence; identical to SEQ ID NO: 878
  derived and/or modified CDS sequence (AUadapt) from InfluenzaA__ABK80278__HA

SEQ ID NO: 1704 - RNA, 1701 nt, Artificial Sequence
  derived and/or modified CDS sequence (AUadapt) from InfluenzaA__ABK80289__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1705 - RNA, 1701 nt, Artificial Sequence; identical to SEQ ID NO: 296
  derived and/or modified CDS sequence (AUadapt) from InfluenzaA__ABK80300__HA

SEQ ID NO: 1706 - RNA, 1701 nt, Artificial Sequence; identical to SEQ ID NO: 296
  derived and/or modified CDS sequence (AUadapt) from InfluenzaA__ABK80311__HA

SEQ ID NO: 1707 - RNA, 1707 nt, Artificial Sequence
  derived and/or modified CDS sequence (AUadapt) from InfluenzaA__ABL07019__HA
auggagaagaucgugcugcuccugucgaucgucucccuggucaagagcgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugcgcgacugcucgguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccggaucaaccacuucgagaagauccagaucauccccaagagcuccuggucggaccacgaggccuccagcggcgucuccucggccugcccguaccugggcucccccagcuucuuccgcaacgugguguggcucacgaagaagaacuccaccuaccccaccaucaagaaguccuacaacaacaccaaccaggaggaccugcugguccucugggggauccaccacccgaacaacgaggccgagcagacgcggcuguaccagaaccccaccaccuacaucuccaucggcaccagcacgcugaaccagcgccucgugcccaagaucgcgacccggucgaaggugaacgggcaguccggccgcauggaguucuucuggaccauccugaagcccaacgacgccaucaacuucgagagcaacgggaacuucaucgccccggaguacgccuacaagaucgucaagaagggcgacuccgcgaucaugaaguccgagcuggaguacucgaacugcaacaccaagugccagacgcccaugggcgccaucaacagcuccaugcccuuccacaacauccacccccucaccaucggggagugcccgaaguacgucaagagcaaccggcuggugcuggccaccggccuccgcaacucgccccagcgggagagccgccggaagaagcgcgggcuguucggcgccaucgccggcuucaucgagggcggguggcaggggaugguggacggcugguacggguaccaccacuccaacgagcagggcucgggcuacgcggccgacaaggaguccacccagaaggccaucgacggggugacgaacaaggugaacagcaucaucgacaagaugaacacccaguucgaggccgucggccgggaguucaacaaccuggagcgccggaucgagaaccucaacaagaagauggaggacggguuccuggacguguggaccuacaacgccgagcugcucgugcugauggagaacgagcgcacccuggacuuccacgacuccaacgucaagaaccucuacgacaaggugcggcugcagcugcgcgacaacgcgaaggagcucggcaacgggugcuucgaguucuaccacaagugcgacaacgagugcauggagagcauccggaacggcacguacaacuacccccaguacuccgaggaggcccgccugaagcgggaggagaucucgggcgucaagcuggaguccaucgggaccuaccagauccucagcaucuacucgaccguggccuccagccuggcccuggccaucaugaucgcgggccucucccuguggaugugcagcaacgggucccugcagugccgcaucugcaucuga

SEQ ID NO: 1708 - RNA, 1707 nt, Artificial Sequence
  derived and/or modified CDS sequence (AUadapt) from InfluenzaA__ABL07030__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccaccaacgaccugugcuaccccggguccuucaacgacuacgaggagcugaagcaccuccugagccggaucaaccacuucgagaagauccagaucaucccgaaguccucgugguccgaccacgaggccagcuccggcgucagcuccgccugccccuaccugggcucgcccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucucgaucggcaccuccacccugaaccagcgccucgugcccaagaucgccacgcggagcaaggugaacgggcagagcggccgcauggaguucuucugggccauccugaagcccaacgacgcgaucaacuucgaguccaacgggaacuucaucgccccggaguacgccuacaagaucgucaagaagggcgacucggccaucaugaaguccgagcuggaguacggcaacugcaacaccaagugccagacccccaugggggccaucaacagcuccaugcccuuccacaacauccacccccucaccaucggcgagugcccgaaguacgugaaguccaaccggcuggugcuggcgacggggcuccgcaacucgccccagcgggagagccgccggaagaagcgcggccuguucggcgccaucgccggguucaucgagggcggguggcagggcauggucgacgggugguacggcuaccaccacuccaacgagcagggcucgggguacgccgccgacaaggaguccacccagaaggcgaucgacggcgugaccaacaaggugaacagcaucaucgacaagaugaacacccaguucgaggccgucgggcgggaguucaacaaccuggagcgccggaucgagaaccucaacaagaagauggaggacggcuuccuggacguguggacguacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucucgggggucaagcuggaguccaucggcaccuaccagauccucagcaucuacuccacgguggcgucgagccuggcccuggccaucaugaucgccgggcucucccuguggaugugcagcaacggcucccugcagugccgcaucugcaucuga

SEQ ID NO: 1709 - RNA, 1707 nt, Artificial Sequence
  derived and/or modified CDS sequence (AUadapt) from InfluenzaA__ABL10088__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccacgaucaagcggucguacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccgaggugaacgggcagagcggccggauggaguucuucuggacgauccucaagcccaacgacgccaucaacuucgagucgaacgggaacuucguggcgcccgaguacgccuacaagaucgucaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgugaaguccaaccgccucgugcuggccaccgggcugcggaacucgccgcagcgcgagcggcgccggaagaagcgcggccucuucggcgccaucgcgggguucaucgagggcggguggcagggcauggucgacgggugguacggcuaccaccacuccaacgagcagggcagcggguacgccgccaacaaggaguccacccagaaggccaucgacggcgugaccaacaaggugaacagcaucaucgacaagaugaacacgcaguucgaggccgucgggcgggaguucaacaaccuggagcgccggaucgagaaccugaacaagaagauggaggacggcuuccucgacguguggaccuacaacgcggagcugcugguccucauggagaacgagcgcacccuggacuuccacgacuccaacgugaagaaccuguacgacaaggugcggcuccagcugcgcgacaacgccaaggagcuggggaacggcugcuucgaguucuaccacaagugcgacaacgagugcauggagucgguccggaacggcaccuacgacuacccccaguacuccgaggaggcccgccucaagcgcgaggagaucagcggggugaagcuggaguccaucggcaucuaccagauccugagcaucuacuccacgguggccucgucccucgcccuggcgaucauggucgccgggcugagccucuggaugugcagcaacggcucccugcagugccggaucugcaucuga

SEQ ID NO: 1710 - RNA, 1707 nt, Artificial Sequence
  derived and/or modified CDS sequence (AUadapt) from InfluenzaA__ABL31766__HA
auggagaagaucgugcugcuccuggccaucgucucguucgugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccaccaacgaccucugcuaccccggguccuucaacgacuacgaggagcugaagcaccuccugagccggaucaaccacuucgagaagauccagaucaucccgaaguccagcugguccgaccacgaggccucguccggcgucagcuccgccugccccuaccugggcagccccuccuucuuccgcaacgugguguggcugaucaagaagaacucgacguaccccaccaucaagaaguccuacaacaacaccaaccaggaggaccuccugguccugugggggauccaccacccgaacgacgcggccgagcagacccggcucuaccagaaccccacgaccuacaucagcaucggcaccuccacccugaaccagcgccuggugcccaagaucgccacgcggucgaaggugaacgggcagagcggccgcauggaguucuucugggccauccucaagcccaacgacgcgaucaacuucgaguccaacgggaacuucaucgccccggaguacgccuacaagaucgucaagaagggcgacagcgccaucaugaaguccgagcuggaguacggcaacugcaacaccaagugccagacccccaugggggccaucaacucguccaugcccuuccacaacauccacccccugaccaucggcgagugcccgaaguacgugaaguccaaccggcucgugcuggcgacggggcugcgcaacagcccccagcgggagagccgccggaagaagcgcggccucuucggcgccaucgccggguucaucgagggcggguggcagggcauggucgacgggugguacggcuaccaccacuccaacgagcagggcucgggguacgccgccgacaaggaguccacccagaaggcgaucgacggcgugaccaacaaggugaacagcaucaucgacaagaugaacacccaguucgaggccgucgggcgggaguucaacaaccuggagcgccggaucgagaaccugaacaagaagauggaggacggcuuccucgacguguggacguacaacgccgagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagucgauccggaacggcaccuacaacuacccccaguacuccgaggaggcccgccucaagcgggaggagaucagcggggucaagcuggaguccaucggcaccuaccagauccugagcaucuacuccacgguggcgucgagccucgcccuggccaucaugaucgccgggcugucccucuggaugugcagcaacggcucccugcagugccgcaucugcaucuga

SEQ ID NO: 1711 - RNA, 1707 nt, Artificial Sequence
  derived and/or modified CDS sequence (AUadapt) from InfluenzaA__ABL31780__HA
auggagaagaucgugcugcuccugucgaucgucucccuggugaaguccgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugcgcgacugcagcgucgcgggguggcugcucggcaacccgaugugcgacgaguucaucaacgugcccgagugguccuacaucguggagaaggccaaccccaccaacgaccugugcuaccccgggucguucaacgacuacgaggagcugaagcaccuccugucccggaucaaccacuucgagaagauccagaucaucccgaagggcagcugguccgaccacgaggccucguccggcgucagcuccgccugccccuaccugcgcagccccuccuucuuccggaacgugguguggcucaucaagaagaacucgacguaccccaccaucaagaaguccuacaacaacaccaaccaggaggaccugcugguccucugggggauccaccacccgaacaacgaggccgagcagacccgccuguaccagaaccccacgaccuacaucagcaucggcaccuccacccugaaccagcggcucgugcccaagaucgcgacgcgcucgaaggugaacgggcagagcggccggauggaguucuucuggaccauccugaagcccaacgacgccaucaacuucgaguccaacgggaacuucaucgccccggaguacgccuacaagaucgucaagaagggcgacagcgcgaucaugaaguccgagcuggaguacggcaacugcaacaccaagugccagacccccaugggggccaucaacucguccaugcccuuccacaacauccacccccucacgaucggcgagugcccgaaguacgucaagagcaaccgccuggugcuggccaccgggcuccggaacucgccccagcgcgagagccggcgcaagaagcggggccuguucggcgccaucgccggguucaucgagggcggguggcagggcaugguggacgggugguacggcuaccaccacuccaacgagcagggcucgggguacgcggccgacaaggaguccacccagaaggccaucgacggcgugaccaacaaggugaacagcaucaucgacaagaugaacacgcaguucgaggccgucgggcgcgaguucaacaaccuggagcggcgcaucgagaaccucaacaagaagauggaggacggcuuccuggacguguggaccuacaacgccgagcugcucgugcugauggagaacgagcggacccuggacuuccacgacuccaacgucaagaaccucuacgacaaggugcgccugcagcugcgggacaacgcgaaggagcucgggaacggcugcuucgaguucuaccacaagugcgacaacgagugcauggagagcauccgcaacggcaccuacaacuacccccaguacuccgaggaggcccggcugaagcgcgaggagaucucgggggucaagcuggaguccaucggcacguaccagauccucagcaucuacuccaccguggccucgagccuggcccuggccaucaugaucgcggggcucucccuguggaugugcagcaacggcucccugcagugccgcaucugcaucuga

SEQ ID NO: 1712 - RNA, 1701 nt, Artificial Sequence
  derived and/or modified CDS sequence (AUadapt) from InfluenzaA__ABL67165__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccuccgggaucugcgacucgccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggaccacgcgucccugcggagccucgucgccuccucgggcacgcuggaguucaacaacgaguccuucgacuggaccggggugacccagaacggcaccucguccgccugcaagcgccggagcaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccagcgggcggaucaccguguccacgaagcgcucgcagcagaccgugaucccgaacaucggcucccggccccgcguccgggacgugucgucccgcaucagcaucuacuggaccaucgugaagcccggcgacauccugcucaucaacuccaccgggaaccugaucgcgccccggggcuacuucaagauccgcucggggaaguccucgaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagaagacgcgggggaucuucggcgccaucgccggguucaucgagaacggcugggagggcauggucgacgggugguacggcuuccgccaccagaacucggaggggaccggccaggccgccgaccugaaguccacccaggcggccaucaaccagaucaacgggaagcugaaccggcucaucggcaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagucgggcuacaaggacuggauccuguggaucagcuucgccaucuccugcuuccugcugugcgucgcccugcucggcuucaucaugugggccugccagaaggggaacauccggugcaacaucugcaucuga

SEQ ID NO: 1713 - RNA, 1701 nt, Artificial Sequence
  derived and/or modified CDS sequence (AUadapt) from InfluenzaA__ABL67176__HA
augaagaccaucaucgcccugucguacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagucguccagcaccgggggcaucugcgacucgccccaccagauccuggacggggagaacugcacgcugaucgacgcccuccugggcgacccccacugcgacggcuuccagaacaaggagugggaccuguucguggagcgcagccgggccuacuccaacugcuaccccuacgacgugccggacuacgccucgcuccgcucccuggucgcgagcuccgggacccuggaguucaacaacgagucguucaacuggaccggcguggcccagaacgggaccuccagcgccugcaagcggcgcuccaacaagucguucuucucccggcucaacuggcugcaccagcugaaguacaaguaccccgcccucaacgugacgaugcccaacaacgagaaguucgacaagcuguacaucuggggcguccaccaccccagcaccgacuccgaccagaucucgcuguacgcgcaggccccggggcgcgugaccgugagcaccaagcggucccagcagacggucauccccaacaucggcucgcgccccugggugcggggcguguccagccgcaucuccaucuacuggaccaucgucaagcccggggacauccuccugaucaacugcaccggcaaccugaucgccccgcggggguacuucaagauccgcucgggcaaguccagcaucaugcgguccgacgccucgaucggcaagugcaacuccgagugcaucacccccaacgggagcauccccaacgacaagcccuuccagaacgugaaccgcaucacguacggcgccugcccgcgguacgugaagcagaacacccucaagcuggcgaccgggaugcgcaacguccccgagaagcagacccggggcaucuucggggccaucgccggcuucaucgagaacggcugggaggggaugguggacggcugguacggguuccgccaccagaacuccgagggcacggggcaggccgccgaccugaaguccacccaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacacgaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucucguucgccaucagcugcuuccugcugugcgugguccuccugggcuucaucaugugggccugccagaaggggaacauccggugcaacaucugcaucuga

SEQ ID NO: 1714 - RNA, 1701 nt, Artificial Sequence; identical to SEQ ID NO: 1677
  derived and/or modified CDS sequence (AUadapt) from InfluenzaA__ABL67187__HA

SEQ ID NO: 1715 - RNA, 1701 nt, Artificial Sequence; identical to SEQ ID NO: 1632
  derived and/or modified CDS sequence (AUadapt) from InfluenzaA__ABL67209__HA

SEQ ID NO: 1716 - RNA, 1701 nt, Artificial Sequence; identical to SEQ ID NO: 1166
  derived and/or modified CDS sequence (AUadapt) from InfluenzaA__ABL67253__HA

SEQ ID NO: 1717 - RNA, 1701 nt, Artificial Sequence
  derived and/or modified CDS sequence (AUadapt) from InfluenzaA__ABL67264__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggucguacaucgccgagacccccaacagcgagaacgggaccugcuaccccggcuacuucgccgacuacgaggagcugcgcgagcagcuguccagcguguccucguucgagcgguucgagaucuuccccaaggaguccagcuggccgaagcacaacgucaccaagggggugacggccuccugcagccacaagggcaaguccagcuucuaccgcaaccuccuguggcugaccgagaagaacggguccuaccccaaccucucgaagagcuacgugaacaacaaggagaaggagguccuggugcuguggggcgugcaccaccccuccaacaucgaggaccagaagaccaucuaccggaaggagaacgccuacgucagcgugguguccucgcacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccagggcgccaucaacuccucguucccguuccagaacgugcaccccgugaccaucggcgagugccccaaguacguccgcuccaccaagcugcggauggugaccgggcugcgcaacauccccagcauccagucccggggccucuucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccugaacaagaagguggacgacggcuuccucgacaucuggacguacaacgccgagcugcuggugcuccuggagaacgagcggacccuggacuuccacgacuccaacgucaagaaccucuacgagaaggucaagucgcagcugaagaacaacgcgaaggagaucgggaacggcugcuucgaguucuaccacaagugcaacaacgagugcauggaguccgugaagaacgggaccuacgacuacccgaaguacagcgaggagagcaagcugaaccgcgagaagaucgacggcgugaagcucgaguccauggggguguaccagauccuggccaucuacucgaccgucgccuccagccuggugcuccuggugucccugggcgccaucagcuucuggaugugcuccaacggcagccuccagugccggaucugcaucuga

SEQ ID NO: 1718 - RNA, 1701 nt, Artificial Sequence
  derived and/or modified CDS sequence (AUadapt) from InfluenzaA__ABL67275__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacgucggcaacggcugcuucaagaucuaccacaagugcgacaacgccugcaucggguccauccggaacggcaccuacgaccacgacguguaccgcgacgaggcccugaacaaccgguuccagaucaagggggucaagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 1719 - RNA, 1701 nt, Artificial Sequence
  derived and/or modified CDS sequence (AUadapt) from InfluenzaA__ABL67286__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaaguccggggacauccuccugaucaacuccaccggcaaccugaucgcgccccggggguacuucaagauccgcagcggcaaguccucgaucaugcgguccgacgcccccaucggcaagugcaacagcgagugcaucaccccgaacggguccauccccaacgacaagcccuuccagaacgugaaccgcaucaccuacggccccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacucggagggcaccgggcaggccgccgaccugaaguccacgcaggccgcgaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacguguaccgggacgaggcgcugaacaaccgcuuccagaucaagggggucgagcucaagagcggcuacaaggacuggauccuguggaucagcuucgccaucuccugcuuccugcugugcaucgugcuccugggcuucaucaugugggccugccagaaggggaacauccggugcaacaucugcaucuga

SEQ ID NO: 1720 - RNA, 1701 nt, Artificial Sequence; identical to SEQ ID NO: 1250
  derived and/or modified CDS sequence (AUadapt) from InfluenzaA__ABL67297__HA

SEQ ID NO: 1721 - RNA, 1701 nt, Artificial Sequence
  derived and/or modified CDS sequence (AUadapt) from InfluenzaA__ABL67308__HA
augaagaccaucaucgcccugucguacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccagcugcuaccccuacgacgugccggacuacgucucccuccgcucgcugguggcguccagcggcacccuggaguucaacaacgaguccuucaacuggacggggguggcccagaacggcaccucguccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggaccgacuccgaccagaucucgcuguacgcgcaggccagcgggcgcgugacggucuccaccaagcggucgcagcagaccgugaucccgaacaucggcucccgccccugggugcggggcgucagcucccgcaucagcaucuacuggaccaucgugaagcccggggacauccuccugaucaacuccacgggcaaccugaucgcgccccggggguacuucaagauccgcucgggcaaguccagcaucaugcgguccgacgccccgaucgacaagugcaacucggagugcaucacccccaacggcuccauccccaacgacaagcccuuccagaacgugaaccgcaucaccuacgggcucugcccgcgguacgucaagcagaacacccugaagcuggccacgggcaugcgcaacgugcccgagaagcagacccgggggaucuucggcgccaucgccggguucaucgagaacggcugggagggcaugauggacgggugguacggcuuccgccaccagaacagcgaggggaccggccaggccgccgaccucaaguccacccaggccgcgaucaaccagaucaacgggaagcugaaccggcugaucgagaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacucggagaugaacaagcuguucgagcggacgaagaagcagcuccgcgagaacgccgaggacaugggcaacgggugcuucaagaucuaccacaagugcgacaacgccugcaucggcuccauccgcaacgggaccuacgaccacgacguguaccgggacgaggcgcugaacaaccgcuuccagaucaagggcgucgagcucaagagcggguacaaggacuggauccuguggaucagcuucgccaucuccugcuuccugcucugcaucgugcugcugggcuucaucaugugggccugccagaagggcaacguccggugcaacaucugcaucuga

SEQ ID NO: 1722 - RNA, 1701 nt, Artificial Sequence; identical to SEQ ID NO: 807
  derived and/or modified CDS sequence (AUadapt) from InfluenzaA__ABL67319__HA

SEQ ID NO: 1723 - RNA, 1701 nt, Artificial Sequence; identical to SEQ ID NO: 1550
  derived and/or modified CDS sequence (AUadapt) from InfluenzaA__ABL67330__HA

SEQ ID NO: 1724 - RNA, 1701 nt, Artificial Sequence; identical to SEQ ID NO: 761
  derived and/or modified CDS sequence (AUadapt) from InfluenzaA__ABL67341__HA

SEQ ID NO: 1725 - RNA, 1701 nt, Artificial Sequence; identical to SEQ ID NO: 761
  derived and/or modified CDS sequence (AUadapt) from InfluenzaA__ABL67352__HA

SEQ ID NO: 1726 - RNA, 1701 nt, Artificial Sequence; identical to SEQ ID NO: 277
  derived and/or modified CDS sequence (AUadapt) from InfluenzaA__ABL67363__HA

SEQ ID NO: 1727 - RNA, 1701 nt, Artificial Sequence
  derived and/or modified CDS sequence (AUadapt) from InfluenzaA__ABL67374__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggcccacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaaccagucguucuucucccgccugaacuggcucacgcaccugaaguucaaguaccccgcccugaacgugaccaugcccaacaacgagaaguucgacaagcucuacaucuggggcgugcaccaccccgggaccgacagcgaccagaucucccuguacgcgcaggccccgggccggaucaccgucucgacgaagcgcucgcagcagaccgugauccccaacaucggcucccggccccgcgugcgggacaucucgucccgcaucagcaucuacuggaccaucgucaagcccggggacauccugcucaucaacuccaccggcaaccugaucgccccgcggggguacuucaagaugcgcucgggcaaguccucgaucaugaaguccgacgcccccaucggcaagugcaacucggagugcaucacgcccaacggguccauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagcgcaccaagaagcagcugcgggagaacgccgaggacaugggcgacgggugcuucaagaucuaccacaagugcgacaacgcgugcaucggcuccauccgcaacgggacguacgaccacgacguguaccgcgacgaggcccucaacaaccgguuccagaucaagggcgucgagcugaaguccggcuacaaggacuggauccuguggaucuccuucgccaucagcugccuccugcugugcguggcccuccugggguucaucaugugggccugccagaagggcaacauccgcugcaacaucugcaucuga

SEQ ID NO: 1728 - RNA, 1701 nt, Artificial Sequence; identical to SEQ ID NO: 527
  derived and/or modified CDS sequence (AUadapt) from InfluenzaA__ABL67385__HA

SEQ ID NO: 1729 - RNA, 1701 nt, Artificial Sequence; identical to SEQ ID NO: 857
  derived and/or modified CDS sequence (AUadapt) from InfluenzaA__ABL67396__HA

SEQ ID NO: 1730 - RNA, 1701 nt, Artificial Sequence; identical to SEQ ID NO: 875
  derived and/or modified CDS sequence (AUadapt) from InfluenzaA__ABL67407__HA

SEQ ID NO: 1731 - RNA, 1701 nt, Artificial Sequence
  derived and/or modified CDS sequence (AUadapt) from InfluenzaA__ABL67418__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcaacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1732 - RNA, 1707 nt, Artificial Sequence; identical to SEQ ID NO: 73
  derived and/or modified CDS sequence (AUadapt) from InfluenzaA__ABL67781__HA

SEQ ID NO: 1733 - RNA, 1707 nt, Artificial Sequence
  derived and/or modified CDS sequence (AUadapt) from InfluenzaA__ABL67794__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccacgaucaagcggucguacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagucgaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacucgccgcagcgcgagaagcggcgcaagaagcggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcaccuacgacuacccccaguacuccgaggaggcccggcucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccgcaucugcaucuga

SEQ ID NO: 1734 - RNA, 1707 nt, Artificial Sequence
  derived and/or modified CDS sequence (AUadapt) from InfluenzaA__ABL67816__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccacgaucaagcggucguacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagucgaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacucgccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucaacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagucggugcggaacggcaccuacgacuacccccaguacuccgaggaggcccgccucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 1735 - RNA, 1707 nt, Artificial Sequence
  derived and/or modified CDS sequence (AUadapt) from InfluenzaA__ABL67827__HA
auggagaagaucgugcugcuguucgccaucgucucgcuggugaaguccgaccacaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagucguccuggagcucccacgaggccagccugggcguguccucggccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccucgacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacgagaucgugaagaagggcgacuccaccaucaugaaguccgagcuggaguacggcaacugcaacaccaagugccagaccccgaugggggccaucaacagcucgaugcccuuccacaacauccacccccugacgaucggcgagugccccaaguacgucaaguccaaccgccucgugcuggccaccgggcugcggaacagcccgcagaucgagcgccggcgcaagaagcggggccucuucggcgccaucgcgggguuccuggagggcggguggcagggcaugguggacgggugguacggcuaccaccacuccaacgagcagggcagcggguacgccgccgacaaggaguccacccagaaggccaucgacggcgucaccaacaaggugaacucgaucaucaacaagaugaacacgcaguucgaggccguggggcgcgaguucaacaaccuggagcggcgcaucgagaaccucaacaagaagauggaggacggcuuccuggacgucuggaccuacaacgcggagcugcucgugcugauggagaacgagcggacccuggacuuccacgacuccaacgucaagaaccucuacgacaaggugcgccugcagcugcgggacaacgccaaggagcucgggaacggcugcuucgaguucuaccacaagugcgacaacgagugcauggagagcgugcgcaacggcaccuacgacuacccccaguacuccgaggaggcccggcugaagcgcgaggagaucagcggggucaagcuggaguccaucggcaucuaccagauccucucgaucuacuccacgguggccagcucccuggcccuggcgaucaugguggccgggcucagccuguggaugugcagcaacggcucccugcagugccgcaucugcaucuga

SEQ ID NO: 1736 - RNA, 1701 nt, Artificial Sequence
  derived and/or modified CDS sequence (AUadapt) from InfluenzaA__ABM22015__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcgacaucugcaucuga

SEQ ID NO: 1737 - RNA, 1701 nt, Artificial Sequence
  derived and/or modified CDS sequence (AUadapt) from InfluenzaA__ABM22026__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagucgugguccuacaucgccgagacccccaaccccaagaacggcacgugcuaccccggcuacuucgccgacuacgaggagcuccgggagcagcugagcuccgugagcuccuucaagcgcuucgagaucuucccgaaggacagcuccuggcccaaccacaccgucaccaagggggugaccgccucgugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucucggugcucuccagccacuacucccgccgguucaccccggagaucgcccgccggcccaaggugcgcgaccaggagggccggaucaacuacuacuggacccugcuggagcccggggacaccaucaucuucgaggccaacggcaaccucaucgcccccugguacgccuucgcgcugagccgcggguucggcuccggcaucaucaucucgaacgccuccaugggggagugcgacgccaagugccagacgccgcagggcgccaucaacagcucccugcccuuccagaacguccaccccgugaccaucggggagugccccaaguacgugcggagcaccaagcuccgcauggucaccggccugcggaacgugccguccauccagagccgcgggcuguucggcgccaucgcgggcuucaucgagggcggguggacggggaugaucgacggcugguacggguaccaccaccagaacgagcagggcuccggcuacgccgccgaccagaaguccacccagaacgccaucaacgggaucaccaacaaggugaacucgaucaucgagaagaugaacacccaguucacggccgucggcaaggaguucaacaagcucgagcggcgcauggagaaccugaacaagaagguggacgacggguuccuggacaucuggaccuacaacgcggagcuccuggugcugcucgagaacgagcggacccuggacuuccacgacagcaacgucaagaaccuguacgagaaggugaagaaccagcucaagaacaacgccaaggagaucggcaacgggugcuucgaguucuaccacaagugcaacaacgagugcauggaguccgucaagaacggcaccuacgacuaccccaaguacagcaaggaguccaagcugaaccgcgagaagaucgacggcgugaagcuggagagcauggggguguaccagauccucgccaucuacucgacggucgccuccagccuggugcugcucgugucccugggcgccaucagcuucuggaugugcuccaacgggagccugcagugccggaucugcaucuga

SEQ ID NO: 1738 - RNA, 1701 nt, Artificial Sequence; identical to SEQ ID NO: 878
  derived and/or modified CDS sequence (AUadapt) from InfluenzaA__ABM22037__HA

SEQ ID NO: 1739 - RNA, 1701 nt, Artificial Sequence; identical to SEQ ID NO: 296
  derived and/or modified CDS sequence (AUadapt) from InfluenzaA__ABM22059__HA

SEQ ID NO: 1740 - RNA, 1701 nt, Artificial Sequence; identical to SEQ ID NO: 1550
  derived and/or modified CDS sequence (AUadapt) from InfluenzaA__ABM22070__HA

SEQ ID NO: 1741 - RNA, 1701 nt, Artificial Sequence
  derived and/or modified CDS sequence (AUadapt) from InfluenzaA__ABM22081__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugucgacgaagcgcucccagcagaccgugaucccgaacaucggcagccggccccgcguccgggacguguccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacauccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 1742 - RNA, 1701 nt, Artificial Sequence
  derived and/or modified CDS sequence (AUadapt) from InfluenzaA__ABM22092__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggaccacgcgucgcugcggucccucgucgccagcuccggcacgcuggaguucaacaacgagucguucgacugggccggggugacccagaacggcaccuccucggccugcaagcgccgguccaacaagagcuucuucucccgccugaacuggcucacccaccugaaguacaaguaccccgcgcugaacgugacgaugcccaacaacgagaaguucgacaagcucuacaucuggggcguccaccaccccgggaccgacucggaccagaucucccuguacgcccaggccucggggcggaucaccgugucgaccaagcgcucccagcagacggugaucccgaacaucggcagccggccccgcguccgggacguguccucgcgcaucuccaucuacuggaccaucgugaagcccggcgacauccugcucaucaacucgaccgggaaccugaucgcgccccggggcuacuucaagauccgcuccgggaaguccuccaucaugcggagcgacgccccgaucggcaagugcaacuccgagugcaucacccccaacggcucgauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgcggaccucaagucgacccaggccgccaucaaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucucguucgccaucagcugcuuccuccugugcgucgcccugcucggcuucaucaugugggcgugccagaaggggaacauccggugcaacaucugcaucuga

SEQ ID NO: 1743 - RNA, 1701 nt, Artificial Sequence; identical to SEQ ID NO: 1555
  derived and/or modified CDS sequence (AUadapt) from InfluenzaA__ABM22103__HA

SEQ ID NO: 1744 - RNA, 1701 nt, Artificial Sequence; identical to SEQ ID NO: 761
  derived and/or modified CDS sequence (AUadapt) from InfluenzaA__ABM22114__HA

SEQ ID NO: 1745 - RNA, 1701 nt, Artificial Sequence; identical to SEQ ID NO: 1700
  derived and/or modified CDS sequence (AUadapt) from InfluenzaA__ABM22125__HA

SEQ ID NO: 1746 - RNA, 1701 nt, Artificial Sequence
  derived and/or modified CDS sequence (AUadapt) from InfluenzaA__ABM22136__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaucgggaugcgcaacgugcccgagaagcagacccggggcaucuucggggccaucgccggcuucaucgagaacggcugggaggggaugguggacggcugguacggguuccgccaccagaacucggagggcaucgggcaggccgccgaccugaaguccacgcaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucacggacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1747 - RNA, 1701 nt, Artificial Sequence; identical to SEQ ID NO: 878
  derived and/or modified CDS sequence (AUadapt) from InfluenzaA__ABM22147__HA

SEQ ID NO: 1748 - RNA, 1701 nt, Artificial Sequence; identical to SEQ ID NO: 1166
  derived and/or modified CDS sequence (AUadapt) from InfluenzaA__ABM22158__HA

SEQ ID NO: 1749 - RNA, 1701 nt, Artificial Sequence; identical to SEQ ID NO: 1166
  derived and/or modified CDS sequence (AUadapt) from InfluenzaA__ABM22169__HA

SEQ ID NO: 1750 - RNA, 1701 nt, Artificial Sequence; identical to SEQ ID NO: 1166
  derived and/or modified CDS sequence (AUadapt) from InfluenzaA__ABM22180__HA

SEQ ID NO: 1751 - RNA, 1701 nt, Artificial Sequence; identical to SEQ ID NO: 1166
  derived and/or modified CDS sequence (AUadapt) from InfluenzaA__ABM22191__HA

SEQ ID NO: 1752 - RNA, 1701 nt, Artificial Sequence; identical to SEQ ID NO: 1166
  derived and/or modified CDS sequence (AUadapt) from InfluenzaA__ABM22202__HA

SEQ ID NO: 1753 - RNA, 1701 nt, Artificial Sequence; identical to SEQ ID NO: 1166
  derived and/or modified CDS sequence (AUadapt) from InfluenzaA__ABM22213__HA

SEQ ID NO: 1754 - RNA, 1701 nt, Artificial Sequence; identical to SEQ ID NO: 1166
  derived and/or modified CDS sequence (AUadapt) from InfluenzaA__ABM22224__HA

SEQ ID NO: 1755 - RNA, 1701 nt, Artificial Sequence; identical to SEQ ID NO: 1166
  derived and/or modified CDS sequence (AUadapt) from InfluenzaA__ABM22235__HA

SEQ ID NO: 1756 - RNA, 1701 nt, Artificial Sequence
  derived and/or modified CDS sequence (AUadapt) from InfluenzaA__ABM22268__HA
augaaggugaagcugcucguccugcugugcgccuucaccgccaccuacgcggacacgaucugcaucggcuaccacgccaacaacucgaccgacaccguggacaccgugcucgagaagaacgucacggugacccacuccgugaaccugcuggaggacagccacaacgggaagcucugccgccugaagggcaccgcgccccugcagcucgggaacugcuccgucgccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgugagcuccuucgagcgcuucgagaucuucccgaaggagagcuccuggcccaaccacaccgugaccaagggggucaccgccucgugcucccacaacggcaagagcuccuucuacaagaaccugcucuggcugacggagaagaacgggcuguaccccaaccucagcaaguccuacgugaacaacaaggagaaggaggugcugguccuguggggcgugcaccaccccagcaacaucggggaccagcgggccaucuaccacaccgagaacgccuacgugucggucguguccagccacuacucccgccgguucaccccggagaucgcgaagcgccccaaggugcgggaccaggagggccgcaucaacuacuacuggacccuccuggagcccggcgacacgaucaucuucgaggccaacgggaaccugaucgcccccugguacgccuucgcccucagccggggcuucggguccggcaucaucaccucgaacgcguccaugggcgagugcgacgccaagugccagaccccgcagggggccaucaacagcucccugcccuuccagaacguccaccccgugaccaucggcgagugccccaaguacgugcgcagcacgaagcugcggauggucaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacccagaacgccaucgacggcaucacgaacaaggugaacucggugaucgagaagaugaacacccaguucaccgccgucgggaaggaguucaacaagcuggagcgccggauggagaaccucaacaagaagguggacgacggcuuccuggacaucuggaccuacaacgccgagcugcucguccugcuggagaacgagcgcacgcucgacuuccacgacagcaacgugaagaaccuguacgagaaggugaagaaccagcugaagaacaacgcgaaggagaucgggaacggcugcuucgaguucuaccacaagugcaacaacgagugcauggaguccgucaagaacgggaccuacgacuaccccaaguacagcgaggaguccaagcucaaccgggagaagaucgacggcgugaagcuggagagcaugggcguguaccagauccuggccaucuacucgaccgucgccuccagccucgugcugcuggugucccucggggccaucagcuucuggaugugcuccaacggcagccugcagugccgcaucugcaucuga

SEQ ID NO: 1757 - RNA, 1701 nt, Artificial Sequence
  derived and/or modified CDS sequence (AUadapt) from InfluenzaA__ABM22279__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggaccgccacaacgggaagcucugccggcugaagggcaccgcgccccugcagcucgggaacugcagcguggccggcuggauccuggggaacccggagugcgagucccuguucucgaaggaguccuggagcuacaucgccgagacccccaaccccgagaacggcacgugcuaccccggcuacuucgccgacuacgaggagcuccgcgagcagcuguccagcgucuccucguucgagcgguucgagaucuucccgaaggaguccagcuggcccaaccacaccgugaccaagggggugaccgccuccugcagccacaacggcaaguccucguucuacaagaaccugcucuggcugacggagaagaacgggcuguaccccaaccucuccaagagcuacgucaacaacaaggagaaggaggugcuggugcuguggggcguccaccaccccuccaacaucggggaccagcgcgccaucuaccacaccgagaacgcguacgugagcguggucucgucccacuacagccggcgcuucaccccggagaucgccaagcggcccaaggugcgcgaccaggagggccggaucaacuacuacuggacccuccuggagcccggcgacacgaucaucuucgaggccaacgggaaccugaucgcccccugguacgccuucgcgcucucccgcggcuucgggucgggcaucaucaccuccaacgccagcaugggcgacugcgacgccaagugccagaccccgcagggggccaucaacuccagccugcccuuccagaacgugcaccccgucaccaucggcgggugccccaaguacgugcgguccacgaagcugcgcauggugaccggccuccggaacaucccgucgauccagucccgcgggcuguucggcgccaucgcgggcuucaucgagggcggguggaccgggaugaucgacggcugguacggguaccaccaccagaacgagcagggcagcggcuacgccgccgacaagaaguccacccagaacgccaucgacgggaucacgaacaaggucaacagcgugaucgagaagaugaacacccaguucaccgccgugggcaaggaguucaacaagcuggagcggcgcauggagaaccucaacaagaaggucgacgacggguuccuggacaucuggaccuacaacgcggagcugcucgugcugcuggagaacgagcggacgcucgacuaccacgacuccaacgucaagaaccuguacgagaaggugaagaaccagcugaagaacaacgccaaggagaucggcaacgggugcuucgaguucuaccacaagugcaacaacgagugcauggagucggugaagaacggcaccuacgacuaccccaaguacuccgaggagagcaagcucaagcgcgagaagaucgacggcgucaagcuggaguccauggggguguaccagauccuggccaucuacagcaccguggccucgucccucguccugcuggugagccucggcgccaucuccuucuggaugugcagcaacgggucccugcagugccggaucugcaucuga

SEQ ID NO: 1758 - RNA, 1701 nt, Artificial Sequence
  derived and/or modified CDS sequence (AUadapt) from InfluenzaA__ABM22290__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggagaacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacucgaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 1759 - RNA, 1701 nt, Artificial Sequence; identical to SEQ ID NO: 500
  derived and/or modified CDS sequence (AUadapt) from InfluenzaA__ABM22301__HA

SEQ ID NO: 1760 - RNA, 1701 nt, Artificial Sequence; identical to SEQ ID NO: 500
  derived and/or modified CDS sequence (AUadapt) from InfluenzaA__ABM22312__HA

SEQ ID NO: 1761 - RNA, 1701 nt, Artificial Sequence; identical to SEQ ID NO: 500
  derived and/or modified CDS sequence (AUadapt) from InfluenzaA__ABM22323__HA

SEQ ID NO: 1762 - RNA, 1701 nt, Artificial Sequence; identical to SEQ ID NO: 500
  derived and/or modified CDS sequence (AUadapt) from InfluenzaA__ABM22334__HA

SEQ ID NO: 1763 - RNA, 1701 nt, Artificial Sequence; identical to SEQ ID NO: 501
  derived and/or modified CDS sequence (AUadapt) from InfluenzaA__ABM22345__HA

SEQ ID NO: 1764 - RNA, 1701 nt, Artificial Sequence; identical to SEQ ID NO: 501
  derived and/or modified CDS sequence (AUadapt) from InfluenzaA__ABM22356__HA

SEQ ID NO: 1765 - RNA, 1701 nt, Artificial Sequence; identical to SEQ ID NO: 501
  derived and/or modified CDS sequence (AUadapt) from InfluenzaA__ABM22367__HA

SEQ ID NO: 1766 - RNA, 1698 nt, Artificial Sequence; identical to SEQ ID NO: 1086
  derived and/or modified CDS sequence (AUadapt) from InfluenzaA__ABM66864__HA

SEQ ID NO: 1767 - RNA, 1701 nt, Artificial Sequence; identical to SEQ ID NO: 1166
  derived and/or modified CDS sequence (AUadapt) from InfluenzaA__ABM66886__HA

SEQ ID NO: 1768 - RNA, 1701 nt, Artificial Sequence; identical to SEQ ID NO: 1166
  derived and/or modified CDS sequence (AUadapt) from InfluenzaA__ABM66897__HA

SEQ ID NO: 1769 - RNA, 1701 nt, Artificial Sequence; identical to SEQ ID NO: 1166
  derived and/or modified CDS sequence (AUadapt) from InfluenzaA__ABM66908__HA

SEQ ID NO: 1770 - RNA, 1701 nt, Artificial Sequence; identical to SEQ ID NO: 501
  derived and/or modified CDS sequence (AUadapt) from InfluenzaA__ABM66919__HA

SEQ ID NO: 1771 - RNA, 1701 nt, Artificial Sequence; identical to SEQ ID NO: 501
  derived and/or modified CDS sequence (AUadapt) from InfluenzaA__ABM66930__HA

SEQ ID NO: 1772 - RNA, 1701 nt, Artificial Sequence; identical to SEQ ID NO: 501
  derived and/or modified CDS sequence (AUadapt) from InfluenzaA__ABM66941__HA

SEQ ID NO: 1773 - RNA, 1701 nt, Artificial Sequence; identical to SEQ ID NO: 501
  derived and/or modified CDS sequence (AUadapt) from InfluenzaA__ABM66952__HA

SEQ ID NO: 1774 - RNA, 1701 nt, Artificial Sequence; identical to SEQ ID NO: 501
  derived and/or modified CDS sequence (AUadapt) from InfluenzaA__ABM66963__HA

SEQ ID NO: 1775 - RNA, 1701 nt, Artificial Sequence; identical to SEQ ID NO: 501
  derived and/or modified CDS sequence (AUadapt) from InfluenzaA__ABM66974__HA

SEQ ID NO: 1776 - RNA, 1701 nt, Artificial Sequence; identical to SEQ ID NO: 501
  derived and/or modified CDS sequence (AUadapt) from InfluenzaA__ABM66985__HA

SEQ ID NO: 1777 - RNA, 1701 nt, Artificial Sequence; identical to SEQ ID NO: 501
  derived and/or modified CDS sequence (AUadapt) from InfluenzaA__ABM66996__HA

SEQ ID NO: 1778 - RNA, 1701 nt, Artificial Sequence; identical to SEQ ID NO: 501
  derived and/or modified CDS sequence (AUadapt) from InfluenzaA__ABM67007__HA

SEQ ID NO: 1779 - RNA, 1701 nt, Artificial Sequence; identical to SEQ ID NO: 501
  derived and/or modified CDS sequence (AUadapt) from InfluenzaA__ABM67018__HA

SEQ ID NO: 1780 - RNA, 1701 nt, Artificial Sequence
  derived and/or modified CDS sequence (AUadapt) from InfluenzaA__ABM67029__HA
augaagaccaucaucgcccugucguacaucaucugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaucuuccucuacgcgcaggccagcgggcggaucaccguguccacgaagcgcucgcagcagaccgugaucccgaacaucggcagccggccccgcguccgggacauccccucccgcaucucgaucuacuggaccaucgugaagcccggcgacauccugcugaucaacuccaccgggaaccucaucgccccgcggggcuacuuccgcauccggagcgggaaguccucgaucaugcgcuccgacgcccccaucggcaagugcaacucggagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccucaaguccacccaggcggccaucaaccagaucaacgggaagcugaaccgccugaucggcaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagcgcaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 1781 - RNA, 1698 nt, Artificial Sequence; identical to SEQ ID NO: 544
  derived and/or modified CDS sequence (AUadapt) from InfluenzaA__ABM67051__HA

SEQ ID NO: 1782 - RNA, 1707 nt, Artificial Sequence
  derived and/or modified CDS sequence (AUadapt) from InfluenzaA__ABM90467__HA
auggagaagaucgugcugcuccugucgaucgucucccuggucaagagcgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugcgcgacugcucgguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccggaucaaccacuucgagaagauccagaucauccccaagagcuccuggucggaccacgaggccuccagcggcgucuccucggccugcccguaccugggcucccccagcuucuuccgcaacgugguguggcucaucaagaagaacuccacguaccccaccaucaagaaguccuacaacaacaccaaccaggaggaccugcugguccucugggggauccaccacccgaacaacgaggccgagcagacccggcuguaccagaaccccacgaccuacaucagcaucggcaccucgacccugaaccagcgccucgugcccaagaucgcgacgcggagcaaggugaacgggcaguccggccgcauggaguucuucuggaccauccugaagcccaacgacgccaucaacuucgagucgaacgggaacuucaucgccccggaguacgccuacaagaucgucaagaagggcgacuccgcgaucaugaaguccgagcuggaguacggcaacugcaacaccaagugccagacccccaugggggccaucaacagcagcaugcccuuccacaacauccacccccucacgaucggcgagugcccgaaguacgugaaguccaaccggcuggugcuggccaccgggcuccgcaacucgccccagcgggagucccgccggaagaagcgcggccuguucggcgccaucgccggguucaucgagggcggguggcagggcauggucgacgggugguacggcuaccaccacagcaacgagcagggcuccggguacgcggccgacaaggagucgacccagaaggccaucgacggcgugaccaacaaggugaacuccaucaucgacaagaugaacacgcaguucgaggccgucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacagcaacgucaagaaccucuacgacaaggugcggcugcagcugcgcgacaacgcgaaggagcucgggaacggcugcuucgaguucuaccacaagugcgacaacgagugcauggaguccauccggaacggcaccuacaacuacccccaguacagcgaggaggcccgccugaagcgggaggagaucuccggggucaagcuggagucgaucggcacguaccagauccucuccaucuacagcaccguggccucgucccuggcccuggccaucaugaucgcggggcucagccuguggaugugcuccaacggcagccugcagugccgcaucugcaucuga

SEQ ID NO: 1783 - RNA, 1707 nt, Artificial Sequence
  derived and/or modified CDS sequence (AUadapt) from InfluenzaA__ABM90511__HA
auggagaagaucgugcugcuccugucgaucgucucccuggucaagagcgaccagaucugcaucggcuaccacgccaacaacuccaccgagcaggucgacaccaucaucgagaagaacgugacggugacccacgcccaggacauccucgagaagacccacaacgggaagcugugcgaccuggacggcgugaagccccucauccugaaggacugcucgguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccgcaucaaccacuucgagaagauccagaucauccccaagagcuccuggucggaccacgaggccuccagcggcgucuccagcgccugcccguaccugggcucccccucguucuuccggaacgugguguggcucaucaagaagaacuccacguaccccaccaucaagaaguccuacaacaacaccaaccaggaggaccugcugguccucugggggauccaccacccgaacaacgaggaggagcagacccgccuguaccagaaccccacgaccuacaucagcaucggcaccagcacccugaaccagcggcucgugcccaagaucgccacgcgcucgaaggugaacgggcaguccggccggauggaguucuucuggaccauccugaagcccaacgacgcgaucaacuucgagagcaacgggaacuucaucgccccggaguacgccuacaagaucgucaagaagggcgacuccgccaucaugaaguccgagcuggaguacagcaacugcaacaccaagugccagacccccaugggcgcgaucaacucguccaugcccuuccacaacauccacccccucacgaucggggagugcccgaaguacgucaagagcucccgccuggugcuggccaccggccuccggaacagcccccagcgcgagucccggcgcaagaagcgggggcuguucggcgccaucgccggcuucaucgagggcggguggcaggggaugguggacggcugguacggguaccaccacucgaacgagcagggcuccggcuacgccgcggacaaggagagcacccagaaggccaucgacggggugaccaacaaggugaacuccaucaucgacaagaugaacacgcaguucgaggccgucggccgcgaguucaacaaccuggagcggcgcaucgagaaccucaacaagaagauggaggacggguuccuggacguguggaccuacaacgccgagcugcucgugcugauggagaacgagcggacccuggacuuccacgacagcaacgucaagaaccucuacgacaaggugcgccugcagcugcgggacaacgccaaggagcucggcaacgggugcuucgaguucuaccacaagugcgacaacgagugcauggaguccauccgcaacggcaccuacaacuacccccaguacucggaggaggcgcggcugaagcgcgaggagaucuccggcgucaagcuggagagcaucgggacguaccagauccucagcaucuacuccaccguggccucgucccuggcccuggccaucaugaucgccggccucagccuguggaugugcuccaacgggagccugcagugccggaucugcaucuga

SEQ ID NO: 1784 - RNA, 1707 nt, Artificial Sequence
  derived and/or modified CDS sequence (AUadapt) from InfluenzaA__ABM90533__HA
auggagaagaucgugcugcuccugucgaucgucucccuggucaagagcgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugaaggacugcucgguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccgcaucaaccacuucgagaagauccagaucauccccaagagcuccuggucggaccacgaggccuccagcggcgucuccagcgccugcccguaccugggcucccccucguucuuccggaacgugguguggcucaucaagaagaacuccacguaccccaccaucaagaaguccuacaacaacaccaaccaggaggaccugcugguccucugggggauccaccacccgaacaacgaggaggagcagacccgccuguaccagaaccccacgaccuacaucagcaucggcaccagcacccugaaccagcggcucgugcccaagaucgccacgcgcucgaaggugaacgggcaguccggccggauggaguucuucuggaccauccugaagcccaacgacgcgaucaacuucgagagcaacgggaacuucaucgccccggaguacgccuacaagaucgucaagaagggcgacuccgccaucaugaaguccgagcuggaguacagcaacugcaacaccaagugccagacccccaugggcgcgaucaacucguccaugcccuuccacaacauccacccccucacgaucggggagugcccgaaguacgucaagagcucccgccuggugcuggccaccggccuccggaacagcccccagcgcgagucccggcgcaagaagcgggggcuguucggcgccaucgccggcuucaucgagggcggguggcaggggaugguggacggcugguacggguaccaccacucgaacgagcagggcuccggcuacgccgcggacaaggagagcacccagaaggccaucgacggggugaccaacaaggugaacuccaucaucgacaagaugaacacgcaguucgaggccgucggccgcgaguucaacaaccuggagcggcgcaucgagaaccucaacaagaagauggaggacggguuccuggacguguggaccuacaacgccgagcugcucgugcugauggagaacgagcggacccuggacuuccacgacagcaacgucaagaaccucuacgacaaggugcgccugcagcugcgggacaacgccaaggagcucggcaacgggugcuucgaguucuaccacaagugcgacaacgagugcauggaguccauccgcaacggcaccuacaacuacccccaguacucggaggaggcgcggcugaagcgcgaggagaucuccggcgucaagcuggagagcaucgggacguaccagauccucagcaucuacuccaccguggccucgucccuggcccuggccaucaugaucgccggccucagccuguggaugugcuccaacgggagccugcagugccggaucugcaucuga

SEQ ID NO: 1785 - RNA, 1707 nt, Artificial Sequence; identical to SEQ ID NO: 1784
  derived and/or modified CDS sequence (AUadapt) from InfluenzaA__ABM90544__HA

SEQ ID NO: 1786 - RNA, 1701 nt, Artificial Sequence
  derived and/or modified CDS sequence (AUadapt) from InfluenzaA__ABN50900__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagagcuccuggccgaagcacaacgucacccggggcgugacggccagcugcucccacaagggcaagagcuccuucuaccgcaaccuccuguggcugaccgagaagaacgggucguaccccaaccucagcaaguccuacgugaacaacaaggagaaggagguccuggugcuguggggcgugcaccaccccagcaacaucgaggaccagaagaccaucuaccggaaggagaacgccuacgucuccguggugucgucccacuacaaccgccgguucacccccgagaucgcgaagcgcccgaagguccgggggcaggagggccgcaucaacuacuacuggacgcuccuggagcccggcgacaccaucaucuucgaggccaacgggaaccugaucgcccccugguacgccuucgcccucagccggggcuucggguccggcaucaucaccagcaacgcguccauggacgagugcgacgccaagugccagacgccccagggcgccaucaacucgucccugccguuccagaacgugcaccccgugaccaucggggagugccccaaguacguccgcagcaccaagcugcggauggugaccggccuccgcaacauccccuccauccagagccgggggcuguucggcgccaucgccggguucaucgagggcggcuggaccgggaugaucgacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagaagcgcauggagaaccucaacaagaagguggacgacggguuccuggacaucuggacguacaacgccgagcugcucguccugcuggagaacgagcggacccucgacuuccacgacucgaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuacccgaaguacagcgaggaguccaagcucaaccgcgagaagaucgacggggugaagcuggagucgaugggcgucuaccagauccuggccaucuacuccaccguggccagcucccucgugcugcuggucagccucggcgccaucuccuucuggaugugcagcaacgggucccugcagugccggaucugcaucuga

SEQ ID NO: 1787 - RNA, 1701 nt, Artificial Sequence; identical to SEQ ID NO: 1166
  derived and/or modified CDS sequence (AUadapt) from InfluenzaA__ABN50917__HA

SEQ ID NO: 1788 - RNA, 1701 nt, Artificial Sequence
  derived and/or modified CDS sequence (AUadapt) from InfluenzaA__ABN50928__HA
augaaggccaagcugcucauccugcugugcgccuucaccgcgaccgacgccgacacgaucugcaucggcuaccacgccaacaacucgaccgacaccguggacaccguccucgagaagaacgugacggugacccacuccgucaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcguguccucguucgagcgcuucgagaucuuccccaaggaguccagcuggccgaaccacacggugaccaagggcgucaccgccuccugcagccacaagggcaaguccagcuucuaccggaaccugcucuggcugaccgagaagaacggguccuaccccaaccugucgaagagcuacgugaacaacaaggagaaggaggugcucguccuguggggcgugcaccaccccuccaacaucggggaccagcgcgccaucuaccacacggagaacgcguacgugagcgucguguccucgcacuacaaccggcgcuucacccccgagaucgccaagcggccgaaggugcgcggccaggagggccggaucaacuacuacuggacccugcucgagcccggggacaccaucaucuucgaggccaacggcaaccugaucgcccccugguacgccuucgcgcugucccgcggguucggcagcggcaucaucacguccaacgccagcauggacgagugcgacgccaagugccagacgccccagggggccaucaacuccucgcucccguuccagaacguccaccccgugaccaucggcgagugccccaaguacgugcgguccaccaagcugcgcauggucaccgggcugcggaacauccccagcauccagucccgcggccucuucggggccaucgcgggcuucaucgagggcggguggaccggcaugaucgacgggugguacggcuaccaccaccagaacgagcaggggagcggcuacgccgccgaccagaaguccacccagaacgccaucaacggcaucaccaacaaggugaacagcgugaucgagaagaugaacacgcaguucaccgccgucgggaaggaguucaacaagcuggagcggcgcauggagaaccugaacaagaagguggacgacggcuuccucgacaucuggaccuacaacgcggagcugcuggugcuccuggagaacgagcggacccuggacuuccacgacuccaacgucaagaaccucuacgagaaggucaagucgcagcugaagaacaacgccaaggagaucgggaacggcugcuucgaguucuaccacaagugcaacaacgagugcauggaguccgugaagaacgggacguacgacuacccgaaguacagcgaggagagcaagcugaaccgcgagaagaucgacggcgugaagcucgaguccaugggcguguaccagauccuggccaucuacucgaccgucgccuccagccuggugcuccuggugucccugggggccaucagcuucuggaugugcuccaacggcagccuccagugccggaucugcaucuga

SEQ ID NO: 1789 - RNA, 1701 nt, Artificial Sequence
  derived and/or modified CDS sequence (AUadapt) from InfluenzaA__ABN50940__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucuccgacuacgaggagcuccgggagcagcugagcuccgugagcuccuucgagcgcuucgagaucuuccccaaggagucguccuggccgaaccacacggucaccaagggggugaccgccagcugcucccacaagggcaagagcuccuucuaccggaaccugcucuggcugaccgagaagaacgggagcuaccccaaccugucgaaguccuacgugaacaacaaggagaaggagguccucgugcuguggggcgugcaccaccccagcaacaucggggaccagcgcgccaucuaccacacggagaacgccuacgucuccguggugagcucccacuacaaccggcgcuucacccccgagaucgcgaagcggccgaagguccgcgaccaggagggccggaucaacuacuacuggacccugcucgagcccgaggacaccaucaucuucgaggccaacggcaaccugaucgcccccugguacgccuucgcccugagccgcggguucggcuccgggaucaucacgucgaacgcguccauggacgagugcgacgccaagugccagacgccccagggcgccaucaacagcucccucccguuccagaacgugcaccccgugaccaucggcgagugccccaaguacguccggagcaccaagcugcgcauggugaccgggcugcggaacauccccuccauccagagccgcggccucuucggggccaucgccggcuucaucgagggcggcuggaccggcaugaucgacgggugguacggcuaccaccaccagaacgagcagggguccggcuacgcggccgaccagaaguccacccagaacgccaucaacgggaucaccaacaaggugaacucggucaucgagaagaugaacacgcaguucaccgccgugggcaaggaguucaacaagcuggagcggcgcauggagaaccugaacaagaagguggacgacggcuuccucgacaucuggaccuacaacgccgagcugcugguccuccuggagaacgagcggacccuggacuuccacgacagcaacgugaagaaccucuacgagaaggucaagucccagcugaagaacaacgcgaaggagaucgggaacggcugcuucgaguucuaccacaagugcaacaacgagugcauggagagcgugaagaacgggacguacgacuacccgaaguacagcgaggaguccaagcugaaccgcgagaagaucgacggcgugaagcucgagucgaugggggucuaccagauccuggccaucuacuccaccguggccagcucccuggugcuccuggucagccugggcgccaucuccuucuggaugugcagcaacggcucccuccagugccggaucugcaucuga

SEQ ID NO: 1790 - RNA, 1701 nt, Artificial Sequence; identical to SEQ ID NO: 1756
  derived and/or modified CDS sequence (AUadapt) from InfluenzaA__ABN50951__HA

SEQ ID NO: 1791 - RNA, 1701 nt, Artificial Sequence
  derived and/or modified CDS sequence (AUadapt) from InfluenzaA__ABN50962__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucucgcggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcucgacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacucgaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgggagaagaucgacggcgucaagcuggagagcaugggcguguaccagauccuggccaucuacucgaccguggccuccagccucguccugcuggugucccucggggccaucagcuucuggaugugcuccaacggcagccugcagugccgcaucugcaucuga

SEQ ID NO: 1792 - RNA, 1701 nt, Artificial Sequence; identical to SEQ ID NO: 1155
  derived and/or modified CDS sequence (AUadapt) from InfluenzaA__ABN50973__HA

SEQ ID NO: 1793 - RNA, 1701 nt, Artificial Sequence; identical to SEQ ID NO: 500
  derived and/or modified CDS sequence (AUadapt) from InfluenzaA__ABN50984__HA

SEQ ID NO: 1794 - RNA, 1701 nt, Artificial Sequence; identical to SEQ ID NO: 501
  derived and/or modified CDS sequence (AUadapt) from InfluenzaA__ABN50995__HA

SEQ ID NO: 1795 - RNA, 1701 nt, Artificial Sequence
  derived and/or modified CDS sequence (AUadapt) from InfluenzaA__ABN51043__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccgggacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 1796 - RNA, 1701 nt, Artificial Sequence; identical to SEQ ID NO: 1641
  derived and/or modified CDS sequence (AUadapt) from InfluenzaA__ABN51054__HA

SEQ ID NO: 1797 - RNA, 1701 nt, Artificial Sequence
  derived and/or modified CDS sequence (AUadapt) from InfluenzaA__ABN51066__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcuccgggagcagcugagcuccgucagcuccuucgagcgcuucgagaucuucccgaagaaguccucguggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcggaccaucuaccacaccgagaacgccuacgugagcguggucuccucgcacuacucccgccgguucaccccggagaucgcgaagcgccccaaggugcgggaccaggagggccgcaucaacuacuacuggacgcuccuggagcccggcgacaccaucaucuucgaggccaacgggaaccugaucgcccccugguacgccuucgcccucagccggggcuucggguccggcaucaucaccagcaacgcguccaugggcgacugcgacgccaagugccagaccccgcagggggccaucaacucgucccugcccuuccagaacgugcaccccgucacgaucggcgagugccccaaguacgugcgcagcaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgacaagaaguccacgcagaacgccaucgacggcaucaccaacaaggucaacucggugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacagcaacgucaagaaccuguacgagaaggugaagaaccagcugaagaacaacgcgaaggagaucgggaacggcugcuucgaguucuaccacaagugcaacaacgagugcaucgaguccgugaagaacgggaccuacgacuaccccaaguacagcgaggaguccaagcucaagcgggagaagaucgacggcgucaagcuggagucgaugggcguguaccagauccuggccaucuacagcaccguggccuccagccucguccugcuggugucccucggggccaucggcuucuggaugugcagcaacgggucccugcagugccgcaucugcaucuga

SEQ ID NO: 1798 - RNA, 1698 nt, Artificial Sequence; identical to SEQ ID NO: 541
  derived and/or modified CDS sequence (AUadapt) from InfluenzaA__ABN51077__HA

SEQ ID NO: 1799 - RNA, 1698 nt, Artificial Sequence; identical to SEQ ID NO: 544
  derived and/or modified CDS sequence (AUadapt) from InfluenzaA__ABN51088__HA

SEQ ID NO: 1800 - RNA, 1701 nt, Artificial Sequence
  derived and/or modified CDS sequence (AUadapt) from InfluenzaA__ABN51099__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucggcagccgccccugggugcggggccuguccucgcgcaucuccaucuacuggaccaucgucaagcccggggacgugcucgugaucaacagcaacggcaaccugaucgcgccgcggggguacuucaagaugcgcaccggcaaguccucgaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacucggaggggaccggccaggccgccgaccugaaguccacccaggccgccaucgaccagaucaacgggaagcucaaccgggucaucgagaagaugaacgagaaguuccaccagaucgagaaggaguucagcgagguggagggccgcauccaggaccuggagaaguacguggaggacacgaagaucgaccugugguccuacaacgcggagcuccuggucgcccuggagaaccagcacaccaucgaccucaccgacucggagaugaacaagcuguucgagaagacccggcgccagcugcgggagaacgccgaggacauggggaacggcugcuucaagaucuaccacaagugcgacaacgccugcaucgaguccauccgcaacggcacguacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 1801 - RNA, 1701 nt, Artificial Sequence
  derived and/or modified CDS sequence (AUadapt) from InfluenzaA__ABN51110__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 1802 - RNA, 1701 nt, Artificial Sequence
  derived and/or modified CDS sequence (AUadapt) from InfluenzaA__ABN51121__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucggcagccgccccugggugcggggccuguccucgcgcaucuccaucuacuggaccaucgucaagcccggggacgugcucgugaucaacagcaacggcaaccugaucgcgccgcggggguacuucaagaugcgcaccggcaaguccucgaucaugcgguccgacgcccccaucgacacgugcaucagcgagugcaucacccccaacggguccauccccaacgacaagccguuccagaacgucaacaagaucaccuacgggaccugccccaaguacgugaagcagaacacgcugaagcucgccaccggcaugcgcaacgugcccgagaagcagacccggggccuguucggcgccaucgccggguucaucgagaacggcugggaggggaugaucgacggcugguacggcuuccgccaccagaacucggaggggaccggccaggcggccgaccugaaguccacgcaggccgccaucgaccagaucaacgggaagcucaaccgggucaucgagaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggaccuggagaugaacaagcuguucgagaagacccggcgccagcuccgggagaacgccgaggacauggggaacggcugcuucaagaucuaccacaagugcgacaacgccugcaucgagucgauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggcgugccagcgcggcaacauccggugcaacaucugcaucuga

SEQ ID NO: 1803 - RNA, 1701 nt, Artificial Sequence
  derived and/or modified CDS sequence (AUadapt) from InfluenzaA__ABN51132__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucggcagccgccccugggugcggggccuguccucgcgcaucuccaucuacuggaccaucgucaagcccggggacgugcucgugaucaacagcaacggcaaccugaucgcgccgcggggguacuucaagaugcgcaccggcaaguccucgaucaugcgguccgacgccagcaucgacacgugcaucuccgagugcaucacccccaacgggucgauccccaacgacaagcccuuccagaacgucaacaagaucaccuacggcgccugcccgaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggucguacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucgagagcauccgcaacggcaccuacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 1804 - RNA, 1698 nt, Artificial Sequence; identical to SEQ ID NO: 1045
  derived and/or modified CDS sequence (AUadapt) from InfluenzaA__ABN51143__HA

SEQ ID NO: 1805 - RNA, 1701 nt, Artificial Sequence
  derived and/or modified CDS sequence (AUadapt) from InfluenzaA__ABN51154__HA
augaagaccaucaucgcccugucguacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagucguccagcaccgggcgcaucugcgacucgccccaccagauccuggacggcgagaacugcacgcugaucgacgcccuccugggggacccccacugcgacggcuuccagaacaaggagugggaccuguucguggagcggagcaaggccuacuccaacugcuaccccuacgacgugccggacuacgucucgcuccgcucccugguggccagcuccggcacccuggaguucaacaacgagucguucaacuggaccgggguggcgcagaacggcaccuccagcgccugcaagcggcgcuccgacaagucguucuucucccggcucaacuggcugcaccagcugaaguacaaguaccccgcccucaacgucacgaugcccaacaacgagaaguucgacaagcuguacaucuggggcgugcaccaccccgggaccgacagcgaccagaucucccuguacgcccaggcgucggggcgcgugaccgucagcaccaagcggucccagcagacggugaucccgaacaucggcucgggccccugggugcgcggggucuccagccggaucuccaucuacuggaccaucgugaagcccggcgacauccuccugaucaacucgaccgggaaccugaucgcgccccgcggcuacuucaagauccgguccggcaagagcuccaucaugcgcucggacgccccgaucgggaagugcaacuccgagugcaucacccccaacggcagcauccccaacgacaagcccuuccagaacgugaaccggaucacguacgggccgugcccccgcuacgucaagcagaacacccucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggacgggccaggccgccgaccugaaguccacccaggccgccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggucguacaacgcggagcugcugguggcccucgagaaccagcacacgaucgaccugaccgacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcccugaacaaccgguuccagaucaagggcgucgagcugaaguccggcuacaaggacuggauccucuggaucucguucgcgaucagcugcuuccugcugugcaucgugcuccugggguucaucaugugggccugccagaagggcaacauccgcugcaacaucugcaucuga

SEQ ID NO: 1806 - RNA, 1701 nt, Artificial Sequence
  derived and/or modified CDS sequence (AUadapt) from InfluenzaA__ABN59390__HA
augaagaccaucaucgcccugucguacaucaucugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaucuuccucuacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcugaucaacuccaccgggaaccucaucgccccgcggggcuacuuccgcauccggagcgggaaguccucgaucaugcgcuccgacgcccccaucggcaagugcaacucggagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccucaaguccacccaggcggccaucaaccagaucaacgggaagcugaaccgccugaucggcaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagcgcaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 1807 - RNA, 1701 nt, Artificial Sequence
  derived and/or modified CDS sequence (AUadapt) from InfluenzaA__ABN59401__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagucgcucuucuccaagaaguccuggagcuacaucgccgagacccccaacucggagaacgggaccugcuaccccggcuacuucgccgacuacgaggagcugcgggagcagcuguccagcguguccucguucgagcgcuucgagaucuuccccaaggagcgguccuggccgaagcacaacaucacccgcggcgucacggccgccugcagccacaagggcaaguccagcuucuaccggaaccuccuguggcugaccgagaagaacggguccuaccccaaccucaacaagucguacgugaacaacaaggagaaggaggugcugguccuguggggcgugcaccaccccuccaacaucgaggaccagaagacccucuaccgcaaggagaacgcguacgugagcgucgugucguccaacuacaaccggcgcuucacccccgagaucgccgagcggccgaaggugcgcgggcaggccggccggaucaacuacuacuggacgcugcuggagcccggcgacaccaucaucuucgaggccaacgggaaccucaucgcccccuggcacgcguucgcccugagccgcggcuucggguccggcaucaucaccucgaacgccuccauggacgagugcgacaccaagugccagacgccccagggcgccaucaacagcucccugccguuccagaacauccaccccgucaccaucggggagugccccaaguacgugcggucgaccaagcuccgcauggugaccggccugcggaacauccccuccauccagagccgcgggcuguucggcgccaucgcgggguucaucgagggcggcuggacggggaugaucgacggcugguacggguaccaccaccagaacgagcagggcuccggguacgccgccgaccagaaguccacccagaacgccaucaacggcaucaccaacaaggucaacagcgugaucgagaagaugaacacccaguucacggccgugggcaaggaguucaacaagcucgagaagcggauggagaaccugaacaagaaggucgacgacggguuccuggacaucuggaccuacaacgcggagcuccuggugcugcucgagaacgagcgcacccuggacuuccacgacucgaacgugaagaaccuguacgagaaggucaagucccagcucaagaacaacgccaaggagaucggcaacgggugcuucgaguucuaccacaagugcaacaacgagugcauggagagcgugaagaacggcaccuacgacuacccgaaguacuccgaggagucgaagcugaaccgggagaagaucgacggggucaagcuggaguccaugggcguguaccagauccucgccaucuacagcacgguggccucgucccugguccugcucgugagccugggcgccaucuccuucuggaugugcagcaacgggucccugcagugccgcaucugcaucuga

SEQ ID NO: 1808 - RNA, 1698 nt, Artificial Sequence
  derived and/or modified CDS sequence (AUadapt) from InfluenzaA__ABN59412__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcugaagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggaguuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 1809 - RNA, 1701 nt, Artificial Sequence
  derived and/or modified CDS sequence (AUadapt) from InfluenzaA__ABN59423__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagcggagcuggccgaagcacaacgucacccgcggggugacggccuccugcagccacaagggcaaguccucguucuaccggaaccuccuguggcugaccgagaagaacggguccuaccccaaccucagcaagagcuacgugaacaacaaggagaaggagguccuggugcuguggggcgugcaccaccccuccaacaucgagaaccagaagaccaucuaccgcaaggagaacgccuacgucucggugguguccagcaacuacaaccggcgcuucacccccgagaucgcggagcggccgaagguccgcgaccaggaggggcggaucaacuacuacuggacgcuccuggagcccggcgacaccaucaucuucgaggccaacggcaaccugaucgcccccugguacgccuucgcccucucccgcggguucggcagcgggaucaucaccuccaacgcgucgauggacgagugcgacaccaagugccagacgccccagggcgccaucaacuccagccugccguuccagaacgugcaccccgugaccaucggcgagugccccaaguacguccgguccaccaagcugcgcauggugaccgggcuccggaacauccccagcauccagucccgcggccuguucggggccaucgccggcuucaucgagggcggcuggacgggcaugaucgacgggugguacggcuaccaccaccagaacgagcaggggucgggcuacgccgcggaccagaaguccacccagaacgccaucaacgggaucaccaacaaggugaacagcgucaucgagaagaugaacacccaguucacggccgugggcaaggaguucaacaagcuggagaagcggauggagaaccucaacaagaagguggacgacggcuuccuggacaucuggaccuacaacgccgagcugcucguccugcuggagaacgagcgcacccucgacuuccacgacuccaacgugaagaaccuguacgagaaggucaagagccagcugaagaacaacgccaaggagaucgggaacggcugcuucgaguucuaccacaagugcaacaacgagugcauggaguccgugaagaacgggaccuacgacuacccgaaguacucggaggagagcaagcucaaccgggagaagaucgacggcgugaagcuggaguccaugggggucuaccagauccuggcgaucuacagcacgguggccuccucgcucgugcugcuggucucccucggcgccaucagcuucuggaugugcuccaacggcagccugcagugccgcaucugcaucuga

SEQ ID NO: 1810 - RNA, 1701 nt, Artificial Sequence; identical to SEQ ID NO: 1011
  derived and/or modified CDS sequence (AUadapt) from InfluenzaA__ABO32656__HA

SEQ ID NO: 1811 - RNA, 1701 nt, Artificial Sequence
  derived and/or modified CDS sequence (AUadapt) from InfluenzaA__ABO32667__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccagcgggcgggugaccguguccaccaagcgcucgcagcagaccgucaucccgaacaucggcucccggcccugggugcgcgacgugagcucccggaucucgaucuacuggacgaucgucaagcccggcgacauccuccugaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacucggaggggaccggccaggccgcggaccugaaguccacgcaggccgccaucaaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacucggagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 1812 - RNA, 1698 nt, Artificial Sequence
  derived and/or modified CDS sequence (AUadapt) from InfluenzaA__ABO32678__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggccgucgggaaggaguucagcaagcuggagcggcgcauggagaaccuccacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacggucgccuccagccucgugcugcuggugucccucggggccaucagcuucuggaugugcuccaacggcagccugcagugccggaucugcaucuga

SEQ ID NO: 1813 - RNA, 1701 nt, Artificial Sequence
  derived and/or modified CDS sequence (AUadapt) from InfluenzaA__ABO32692__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcgugguccugcucggguucaucaugugggccugccagaagggcaacauccggugcaacaucugcaucuga

SEQ ID NO: 1814 - RNA, 1701 nt, Artificial Sequence; identical to SEQ ID NO: 1678
  derived and/or modified CDS sequence (AUadapt) from InfluenzaA__ABO32751__HA

SEQ ID NO: 1815 - RNA, 1701 nt, Artificial Sequence; identical to SEQ ID NO: 1678
  derived and/or modified CDS sequence (AUadapt) from InfluenzaA__ABO32762__HA

SEQ ID NO: 1816 - RNA, 1701 nt, Artificial Sequence; identical to SEQ ID NO: 1700
  derived and/or modified CDS sequence (AUadapt) from InfluenzaA__ABO32775__HA

SEQ ID NO: 1817 - RNA, 1701 nt, Artificial Sequence; identical to SEQ ID NO: 488
  derived and/or modified CDS sequence (AUadapt) from InfluenzaA__ABO32790__HA

SEQ ID NO: 1818 - RNA, 1701 nt, Artificial Sequence
  derived and/or modified CDS sequence (AUadapt) from InfluenzaA__ABO32803__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgucagccugcggucccucguggcgucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcccaggcguccggccggaucaccgugucgacgaagcgcucgcagcagaccgucaucccgaacaucggcucccggccccgcgugcgggacauccccagccgcaucuccaucuacuggaccaucgugaagcccggggacacccugcucaucaacucgacgggcaaccugaucgccccgcggggguacuucaagauccgcuccggcaagagcuccaucaugcggucggacgcccccaucgacaagugcaacuccgagugcaucacccccaacggcucgauccccaacgacaagccguuccagaacgucaaccgcaucaccuacggggccugcccccgguacgugaagcagaacacccugaagcucgccacgggcaugcgcaacgugcccgagaagcagacccgggggaucuucggcgcgaucgccggguucaucgagaacggcugggagggcauggucgacgggugguacggcuuccgccaccagaacuccgaggggaucggccaggccgccgaccugaaguccacccaggccgcgaucaaccagaucaacgggaagcugaaccggcucaucggcaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgccugcaucgggucgauccgcaacggcacguacgaccacgacguguaccgggacgaggcgcucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 1819 - RNA, 1701 nt, Artificial Sequence; identical to SEQ ID NO: 878
  derived and/or modified CDS sequence (AUadapt) from InfluenzaA__ABO32816__HA

SEQ ID NO: 1820 - RNA, 1701 nt, Artificial Sequence; identical to SEQ ID NO: 501
  derived and/or modified CDS sequence (AUadapt) from InfluenzaA__ABO32827__HA

SEQ ID NO: 1821 - RNA, 1701 nt, Artificial Sequence
  derived and/or modified CDS sequence (AUadapt) from InfluenzaA__ABO32838__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagcgcugggaccuguucguggagcggagcaaggccuacuccaacugcuaccccuacgacgugccggacuacgcgucgcugcgcucccucgucgccagcuccgggacgcuggaguucaacaacgagucguucaacuggaccggcgugacccagaacgggaccuccucggccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccgcaucaccguguccacgaagcggagccagcagaccgugaucccgaacaucggcucgcgcccccggguccgcaacauccccucccggaucagcaucuacuggaccaucgugaagcccggggacauccugcucaucaacuccaccggcaaccugaucgccccgcgcggguacuucaagauccggucgggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 1822 - RNA, 1701 nt, Artificial Sequence; identical to SEQ ID NO: 1821
  derived and/or modified CDS sequence (AUadapt) from InfluenzaA__ABO32849__HA

SEQ ID NO: 1823 - RNA, 1701 nt, Artificial Sequence
  derived and/or modified CDS sequence (AUadapt) from InfluenzaA__ABO32860__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagcgcugggaccuguucguggagcggagcaaggccuacuccaacugcuaccccuacgacgugccggacuacgcgucgcugcgcucccucgucgccagcuccgggacgcuggaguucaacaacgagucguucaacuggaccggcgugacccagaacgggaccuccucggccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccgcaucaccguguccacgaagcggagccagcagaccgugaucccgaacaucggcucgcgcccccggguccgcgacauccccucccggaucagcaucuacuggaccaucgugaagcccggggacauccugcucaucaacuccaccggcaaccugaucgccccgcgcggguacuucaagauccggucgggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 1824 - RNA, 1701 nt, Artificial Sequence; identical to SEQ ID NO: 1806
  derived and/or modified CDS sequence (AUadapt) from InfluenzaA__ABO32871__HA

SEQ ID NO: 1825 - RNA, 1701 nt, Artificial Sequence
  derived and/or modified CDS sequence (AUadapt) from InfluenzaA__ABO32882__HA
augaagaccaucaucgcccugucguacaucaucugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcgagaacugcacccucaucgacgcccugcugggggacccccagugcgacggcuuccagaacaagaagugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcaagcgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaucuucccguacgcgcaggccagcgggcggaucaccguguccacgaagcgcucgcagcagaccgugauccccaacaucggcucgcggccccgcguccggaacauccccucccgcaucagcaucuacuggaccaucgugaagccgggcgacauccuccugaucaacuccaccgggaaccugaucgcgccccggggcuacuuccgcauccggucggggaaguccagcaucaugcgcuccgacgcccccaucggcaagugcaacucggagugcaucacgcccaacggcuccaucccgaacgacaagcccuuccagaacgugaaccggaucaccuacggggccugcccccgcuacgucaagcagaacacccucaagcuggccaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucaaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacucggagaugaacaagcuguucgagcgcaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 1826 - RNA, 1701 nt, Artificial Sequence
  derived and/or modified CDS sequence (AUadapt) from InfluenzaA__ABO32893__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 1827 - RNA, 1701 nt, Artificial Sequence; identical to SEQ ID NO: 1826
  derived and/or modified CDS sequence (AUadapt) from InfluenzaA__ABO32904__HA

SEQ ID NO: 1828 - RNA, 1701 nt, Artificial Sequence; identical to SEQ ID NO: 1641
  derived and/or modified CDS sequence (AUadapt) from InfluenzaA__ABO32915__HA

SEQ ID NO: 1829 - RNA, 1701 nt, Artificial Sequence; identical to SEQ ID NO: 1641
  derived and/or modified CDS sequence (AUadapt) from InfluenzaA__ABO32926__HA

SEQ ID NO: 1830 - RNA, 1701 nt, Artificial Sequence
  derived and/or modified CDS sequence (AUadapt) from InfluenzaA__ABO32937__HA
augaagaccaucaucgcccugucguacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgucgcugcgcucccucgucgccagcuccggcacgcuggaguucaacaacgagucguucaacuggaccggggugacccagaacggcaccuccagcuccugcaagcggcgcucgaacaacuccuucuucagccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcccaggcguccgggcgcaucaccgugucgacgaagcggagccagcagaccgugaucccgaacaucggcucccgcccccggguccgcaacauccccucgcggaucuccaucuacuggaccaucgugaagcccggcgacauccugcucaucaacagcaccgggaaccugaucgccccgcgcggcuacuucaagauccgguccgggaaguccuccaucaugcgcucggacgcccccaucggcaagugcaacuccgagugcaucacgcccaacggcagcauccccaacgacaagccguuccagaacgugaaccggaucaccuacggggccugcccccgcuacgucaagcagaacacccugaagcucgccaccggcaugcggaacgugcccgagaagcagacgcgcgggaucuucggcgcgaucgccggguucaucgagaacggcugggagggcaugguggacgggugguacggcuuccggcaccagaacuccgaggggaucggccaggccgccgaccucaagucgacccaggccgcgaucaaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgcgagaacgccgaggacauggggaacggcugcuucaagaucuaccacaagugcgacaacgccugcaucgggucgauccggaacggcaccuacgaccacgacgucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 1831 - RNA, 1698 nt, Artificial Sequence
  derived and/or modified CDS sequence (AUadapt) from InfluenzaA__ABO32948__HA
augcgcgccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgggagcagcucuccagcguguccagcuucgagcgcuucgagaucuucccgaagggguccucguggcccaaccacaccgugaccggcgucuccgccagcugcucccacaacggcaagagcuccuucuaccggaaccugcuguggcucaccgggaagaacgggcuguaccccaaccugagcauguccuacgugaacaacaaggagaaggaggugcucguccuguggggcgugcaccacccgcccaacaucggcgaccagcgcgcccuguaccacacggagaacgccuacgugagcgucgugagcucccacuacucgcggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacucgaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 1832 - RNA, 1698 nt, Artificial Sequence
  derived and/or modified CDS sequence (AUadapt) from InfluenzaA__ABO32959__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagccgguccuacgugaacaacaaggagaaggaggugcucguccuguggggcgugcaccacccgcccaacaucggggaccagcgcgcccuguaccacacggagaacgccuacgugucggucgugagcucccacuacagccggcgcuucacccccgagaucgccaagcggcccaaggugcgcgaccaggagggccggaucaacuacuacuggacccuccuggagcccggggacacccugaucuucgaggcgaacggcaaccucaucgccccgugguacgccuucgcccugucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucgaccaagcuccgcauggucaccgggcugcggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcucgagcggcgcauggagaaccugaacaagaaggucgacgacggcuuccuggacaucuggaccuacaacgccgagcuccuggugcugcucgagaacgagcggacccuggacuuccacgacagcaacgugaagaaccuguacgagaaggucaagucccagcucaagaacaacgccaaggagaucgggaacggcugcuucgaguucuaccacaagugcaacaacgagugcauggagagcgugaagaacgggacguacgacuaccccaaguacuccgaggagucgaagcugaaccgcgagaagaucgacggcgugaagcuggaguccaugggcgucuaccagauccucgcgaucuacagcaccguggccagcucccuggugcugcucgucagccugggggccaucuccuucuggaugugcagcaacggcucccugcagugccggaucugcaucuga

SEQ ID NO: 1833 - RNA, 1698 nt, Artificial Sequence; identical to SEQ ID NO: 1449
  derived and/or modified CDS sequence (AUadapt) from InfluenzaA__ABO32970__HA

SEQ ID NO: 1834 - RNA, 1701 nt, Artificial Sequence
  derived and/or modified CDS sequence (AUadapt) from InfluenzaA__ABO32981__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagcggagcuggccgaagcacaacgucacccgcggggugacggccuccugcagccacaagggcaaguccucguucuaccggaaccuccuguggcugaccgagaagaacggguccuaccccaaccucagcaagagcuacgugaacaacaaggagaaggagguccuggugcuguggggcgugcaccaccccuccaacaucaaggaccagaagaccaucuaccgcaaggagaacgccuacgucucggugguguccagcaacuacaaccggcgcuucacccccgagaucgcggagcggccgaagguccgcgaccaggccgggcggaucaacuacuacuggacgcuccuggagcccggcgacaccaucaucuucgaggccaacggcaaccugaucgcccccugguacgccuucgcgcucucccgcggguucggcagcgggaucaucaccuccaacgccucgauggacgagugcgacaccaagugccagacgccccagggcgccaucaacuccagccugccguuccagaacgugcaccccgugaccaucggcgagugccccaaguacguccgguccaccaagcugcgcauggugaccgggcuccggaacauccccagcauccagucccgcggccuguucggggccaucgccggcuucaucgagggcggcuggacgggcaugaucgacgggugguacggcuaccaccaccagaacgagcaggggucgggcuacgcggccgaccagaaguccacccagaacgccaucaacgggaucaccaacaaggugaacagcgucaucgagaagaugaacacccaguucacggccgugggcaaggaguucaacaagcuggagaagcggauggagaaccucaacaagaagguggacgacggcuuccuggacaucuggaccuacaacgccgagcugcucguccugcuggagaacgagcgcacccucgacuuccacgacuccaacgugaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacucggaggagagcaagcucaaccgggagaagaucgacggcgugaagcuggaguccaugggggucuaccagauccuggccaucuacagcacgguggccuccucgcucgugcugcuggucucccucggcgccaucagcuucuggaugugcuccaacggcagccugcagugccgcaucugcaucuga

SEQ ID NO: 1835 - RNA, 1701 nt, Artificial Sequence
  derived and/or modified CDS sequence (AUadapt) from InfluenzaA__ABO32992__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagcggagcuggccgaagcacgacgucacccgcggggugacggccuccugcagccacaagggcaaguccagcuucuaccggaaccuccuguggcugaccgagaagaacggguccuaccccaaccucucgaagagcuacgugaacaacaaggagaaggagguccuggugcuguggggcgugcaccaccccuccaacaucgaggaccagaagaccaucuaccgcaaggagaacgccuacgucagcgugguguccucgaacuacaaccggcgcuucacccccgagaucuccgagcggccgaagguccgcgaccagaaggggcggaucaacuacuacuggacgcuccuggagcccggcgacaccaucaucuucgaggcgaacggcaaccugaucgcccccugguacgccuucgcccucagccgcggguucggcuccgggaucaucaccagcaacgccuccauggacgagugcgacaccaagugccagacgccccagggcgcgaucaacucgucccugccguuccagaacgugcaccccgugaccaucggcgagugccccaaguacguccggagcaccaagcugcgcauggugaccgggcuccggaacauccccuccauccagagccgcggccuguucggggccaucgccggcuucaucgagggcggcuggacgggcaugaucgacgggugguacggcuaccaccaccagaacgagcagggguccggcuacgccgccgaccagaaguccacccagaacgcgaucaacgggaucaccaacaaggugaacagcgucaucgagaagaugaacacccaguucacggccgugggcaaggaguucaacaagcuggagaagcggauggagaaccucaacaagaagguggacgacggcuuccuggacaucuggaccuacaacgccgagcugcucguccugcuggagaacgagcgcacccucgacuuccacgacucgaacgugaagaaccuguacgagaaggucaagucccagcugaagaacaacgccaaggagaucgggaacggcugcuucgaguucuaccacaagugcaacaacgagugcauggagagcgugaagaacgggaccuacgacuacccgaaguacagcgaggaguccaagcucaaccgggagaagaucgacggcgugaagcuggagucgaugggggucuaccagauccuggccaucuacuccacgguggcgagcucccucgugcugcuggucagccucggcgccaucuccuucuggaugugcagcaacggcucccugcagugccgcaucugcaucuga

SEQ ID NO: 1836 - RNA, 1701 nt, Artificial Sequence
  derived and/or modified CDS sequence (AUadapt) from InfluenzaA__ABO33006__HA
augaaggccaagauccuggugcuccugugcgcccugucggcgaccgacgccgacaccaucugcaucggcuaccacgccaacaacuccacggacaccgucgacaccgugcucgagaagaacgugaccgucacgcacagcgugaaccugcuggaggacucccacaacgggaagcucugccgccugaagggcaucgcgccccugcagcucgggaagugcagcaucgccggcuggauccuggggaacccggagugcgagucccuguucucgaagaaguccuggagcuacaucgccgagacccccaacuccgagaacgggaccugcuaccccggcuacuucgccgacuacgaggagcuccgggagcagcugagcuccgugucguccuucgagcgcuucgagaucuuccccaaggagcggagcuggccgaagcacaacgucacccgcggggugacggccuccugcagccacaagggcaaguccagcuucuaccggaaccugcucuggcugaccgagaagaacggguccuaccccaaccugucgaagagcuacgugaacaacaaggagaaggagguccucgugcuguggggcgugcaccaccccuccaacaucgaggaccagaagaccaucuaccgcaaggagaacgccuacgucagcgugguguccucgaacuacaaccggcgcuucacccccgagaucuccaagcggccgaagguccgcgaccaggaggggcggaucaacuacuacuggacgcugcucgagcccggcgacaccaucaucuucgaggcgaacggcaaccugaucgcccccugguacgccuucgcccugagccgcggguucggcuccgggaucaucaccagcaacgccuccauggacgagugcgacaccaagugccagacgccccagggcgcgaucaacucgucccucccguuccagaacgugcaccccgugaccaucggcgagugccccaaguacguccggagcaccaagcugcgcauggugaccgggcugcggaacauccccuccauccagagccgcggccucuucggggccaucgccggcuucaucgagggcggcuggacgggcaugaucgacgggugguacggcuaccaccaccagaacgagcagggguccggcuacgccgccgaccagaaguccacccagaacgcgaucaacgggaucaccaacaaggugaacagcgucaucgagaagaugaacacccaguucacggccgugggcaaggaguucaacaagcuggagaagcggauggagaaccugaacaagaagguggacgacggcuuccucgacaucuggaccuacaacgccgagcugcugguccuccuggagaacgagcgcacccuggacuuccacgacucgaacgugaagaaccucuacgagaaggucaagucccagcugaagaacaacgccaaggagaucgggaacggcugcuucgaguucuaccacaagugcaacaacgagugcauggagagcgugaagaacgggaccuacgacuacccgaaguacagcgaggaguccaagcugaaccgggagaagaucgacggcgugaagcucgagucgaugggggucuaccagauccuggccaucuacuccacgguggcgagcucccuggugcuccuggucagccugggcgccaucuccuucuggaugugcagcaacggcucccuccagugccgcaucugcaucuga

SEQ ID NO: 1837 - RNA, 1701 nt, Artificial Sequence
  derived and/or modified CDS sequence (AUadapt) from InfluenzaA__ABO33025__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggucguacaucgccgagacccccaacagcgagaacgggaccugcuaccccggcuacuucgccgacuacgaggagcugcgcgagcagcuguccagcguguccucguucgagcgguucgagaucuuccccaaggaguccagcuggccgaaccacaacgucaccaagggggugacggccuccugcagccacaagggcaaguccagcuucuaccgcaaccuccuguggcugaccgagaagaacggguccuaccccaaccucucgaagagcuacgugaacaacaaggagaaggagguccuggugcuguggggcgugcaccaccccuccaacaucaaggaccagcggaccaucuaccgcaaggagaacgccuacgucagcgugguguccucgcacuacaaccggcgcuucacccccgagaucgcgaagcggccgaagguccgcgaccaggaggggcggaucaacuacuacuggacgcuccuggagcccggcgacaccaucaucuucgaggccaacggcaaccugaucgcccccugguacgccuucgcccucucccgcggguucggcagcgggaucaucaccuccaacgcgagcauggacgagugcgacgccaagugccagacgccccagggcgccaucaacuccucgcugccguuccagaacgugcaccccgugaccaucggcgagugccccaaguacguccgguccaccaagcugcgcauggugaccgggcuccggaacauccccagcauccagucccgcggccuguucggggccaucgccggcuucaucgagggcggcuggaccggcaugaucgacgggugguacggcuaccaccaccagaacgagcaggggagcggcuacgcggccgaccagaaguccacgcagagcgccaucaacgggaucaccaacaaggugaacuccaucaucgagaagaugaacacccaguucaccgccgucggcaaggaguucaacaagcuggagaagcggauggagaaccucaacaagaagguggacgacggcuuccuggacaucuggacguacaacgccgagcugcucgugcugcuggagaacgagcgcacccucgacuuccacgacucgaacgucaagaaccuguacgagaaggugaagucccagcugaagaacaacgcgaaggagaucgggaacggcugcuucgaguucuaccacaagugcaacaacgagugcauggagagcgucaagaacgggaccuacgacuacccgaaguacagcgaggaguccaagcucaaccgggagaagaucgacggcgugaagcuggagucgauggggguguaccagauccuggccaucuacuccaccgucgccagcucccucgugcugcuggugagccucggcgccaucuccuucuggaugugcagcaacggcucccugcagugccgcaucugcaucuga

SEQ ID NO: 1838 - RNA, 1701 nt, Artificial Sequence
  derived and/or modified CDS sequence (AUadapt) from InfluenzaA__ABO33036__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcaacucgccccaccagauccuggacggcgagaacugcacccugaucgacgcccuccugggggacccccacugcgacggcuuccagaacaaggagugggaccuguucguggagcggcgcaaggccuacagcaacugcuaccccuacgacgugccggacuacgcgucccuccggucgcuggucgccuccagcggcacgcuggaguucaacaacgaguccuucaacuggaccgggguggcccagaacggcaccucguccgccugcaagcgccggagcaucaaguccuucuucucgcgccucaacuggcugcaccagcugaaguacaaguaccccgcgcucaacgugaccaugcccaacaacgagaaguucgacaagcuguacaucuggggcguccaccaccccuccacggacagcgaccagaucucccuguacgcccaggccucggggcgggugaccgugagcaccaagcgcucccagcagaccgucaucccgaacaucgggucgcggcccugggugcgcggcguguccagccggaucuccaucuacuggacgaucgucaagcccggcgacauccuccugaucaacucgaccgggaaccugaucgcgccccgcggcuacuucaagauccgguccgggaaguccuccaucaugcgcagcgacgccccgaucggcaagugcaacuccgagugcaucacccccaacggcucgauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcugaaguccggguacaaggacuggauccucuggaucucguucgccaucagcugcuuccugcugugcgugguccuccugggcuucaucaugugggccugccagaagggcaacauccgcugcaacaucugcaucuga

SEQ ID NO: 1839 - RNA, 1701 nt, Artificial Sequence; identical to SEQ ID NO: 317
  derived and/or modified CDS sequence (AUadapt) from InfluenzaA__ABO33047__HA

SEQ ID NO: 1840 - RNA, 1701 nt, Artificial Sequence; identical to SEQ ID NO: 895
  derived and/or modified CDS sequence (AUadapt) from InfluenzaA__ABO33058__HA

SEQ ID NO: 1841 - RNA, 1701 nt, Artificial Sequence
  derived and/or modified CDS sequence (AUadapt) from InfluenzaA__ABO33069__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuucuccaacugcuaccccuacgacgugccggacuacgcgagccugcggucccucgucgccagcuccggcacgcuggaguucaucaacgagggguucaacuggaccggcgugacccagaacgggggcucguacgccugcaagcgcgggcccgacaacuccuucuucagccggcugaacuggcucuacgaguccgagucgaaguaccccgugcugaacgucaccaugcccaacaacgacaacuucgacaagcuguacaucuggggcgugcaccacccguccacggacaaggagcagaccaaccucuacgugcaggccagcggccgcgucaccguguccaccaagaagucccagcagacgaucauccccaacguggggucgcggcccuggguccgcggccuguccagccggaucuccaucuacuggaccaucgugaagcccggggacauccugcucaucaacagcaacggcaaccugaucgcgccgcgcggcuacuucaagauccggaccgggaaguccucgaucaugcgcuccgacgcccccaucgggaccugcagcuccgagugcaucacgcccaacggcucgauccccaacgacaagccguuccagaacgugaacaagaucaccuacggcgccugccccaaguacgucaagcagaacacccugaagcucgccaccgggaugcggaacgugcccgagaagcagacgcgcggcaucuucggcgccaucgcgggguucaucgagaacggcugggaggggaugguggacggcugguacggguuccggcaccagaacuccgagggcaccggccaggccgccgaccucaagagcacccaggccgccaucgaccagaucaacgggaagcugaaccgcgucaucgagaagaccaacgagaaguuccaccagaucgagaaggaguucuccgagguggagggccggauccaggaccucgagaaguacaucgaggacacgaagaucgaccuguggucguacaacgcggagcugcucguggcccuggagaaccagcacaccaucgaccugaccgacuccaagaugaacaagcuguucgagaagacccgccggcagcugcgcgagaacgccgaggacauggggaacggcugcuucaagaucuaccacaagugcgacaacgccugcaucgggagcauccggaacggcacguacgaccacgacgucuaccgcgacgaggcccugaacaaccgcuuccagaucaagggcguggagcucaaguccggguacaaggacuggauccuguggaucagcuucgcgaucuccugcuuccugcucugcgucgugcugcugggcuucaucaugugggccugccagaaggggaacauccggugcaacaucugcaucuga

SEQ ID NO: 1842 - RNA, 1701 nt, Artificial Sequence; identical to SEQ ID NO: 1166
  derived and/or modified CDS sequence (AUadapt) from InfluenzaA__ABO37988__HA

SEQ ID NO: 1843 - RNA, 1701 nt, Artificial Sequence
  derived and/or modified CDS sequence (AUadapt) from InfluenzaA__ABO38010__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagucgcuguucuccaaggagagcugguccuacaucgccgagacccccaaccccgagaacggcacgugcuaccccggcuacuucgccgacuacgaggagcuccgggagcagcugagcuccgucucguccuucgagcgcuucgagaucuucccgaaggagagcuccuggcccaaccacaccgugaccaagggggugaccgccagcugcucccacaacggcaagucguccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugucgguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcgugggguccggcaucaucaccucgaacgccuccaugggcgacugcgacgccaagugccagaccccgcagggggccaucaacagcucccugcccuuccagaacguccaccccgugaccaucggcgagugccccaaguacgugcgcagcacgaagcugcggauggucaccgggcuccgcaacaucccguccauccagucgcggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggugaacagcgugaucgagaagaugaacacccaguucaccgccgucgggaaggaguucaacaagcuggagcgccggauggagaaccucaacaagaagguggacgacggcuuccuggacaucuggaccuacaacgcggagcugcucguccugcuggagaacgagcgcacgcucgacuuccacgacagcaacgugaagaaccuguacgagaaggugaagaaccagcugaagaacaacgccaaggagaucgggaacggcugcuucgaguucuaccacaagugcaacaacgagugcauggaguccgucaagaacgggaccuacgacuaccccaaguacucggaggaguccaagcucaagcgggagaagaucgacggcgugaagcuggagagcaugggcguguaccagauccuggccaucuacagcaccgucgccuccucgcucgugcugcuggugucccucggggccaucagcuucuggaugugcuccaacggcagccugcagugccgcaucugcaucuga

SEQ ID NO: 1844 - RNA, 1698 nt, Artificial Sequence
  derived and/or modified CDS sequence (AUadapt) from InfluenzaA__ABO38021__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugauccccaaggagagcugguccuacaucgucgagacccccaaccccgagaacggcacgugcuacccgggcuacuucgccgacuacgaggagcugcgcgagcagcucagcuccgugucguccuucgagcgguucgagaucuuccccaaggagagcuccuggcccaaccacaccgugaccggggucagcgccuccugcagccacaacggcaaguccucguucuaccgcaaccugcuguggcucaccgggaagaacggccuguaccccaaccuguccaagagcuacgccaacaacaaggagaaggaggugcucgugcuguggggcguccaccacccgcccaacaucggggaccagcgggcccuguaccacacggagaacgccuacguguccguggucagcagccacuacucccgccgguucauccccgagauggcgaagcgccccaaggugcgggaccaggagggccgcaucaacuacuacuggacccuccuggagccgggggacaccaucaucuucgaggccaacggcaaccugaucgcccccugguacgccuucgcccucucgcggggguucggcuccggcaucaucaccagcaacgcgcccaugggggagugcgacgccaagugccagacgccccagggcgccaucaacuccagccugccguuccagaacgugcaccccgucaccaucggggagugccccaaguacgugcgcuccgccaagcugcggauggugaccggccuccgcaacauccccagcauccagucccgggggcuguucggcgccaucgcgggcuucaucgagggcggguggaccgggauggucgacggcugguacggguaccaccaccagaacgagcagggcucgggcuacgccgccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguuccuggacaucuggacguacaacgcggagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacaacgagugcauggaguccgugaagaacggcaccuacgacuacccgaaguacagcgaggaguccaagcucaaccgggagaagaucgacggcgugaagcuggagucgauggggguguaccagauccuggccaucuacuccaccgucgccagcagccucgugcugcuggugucccucggcgccaucagcuucuggaugugcuccaacgggagccugcagugccgcaucugcaucuga

SEQ ID NO: 1845 - RNA, 1698 nt, Artificial Sequence
  derived and/or modified CDS sequence (AUadapt) from InfluenzaA__ABO38032__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccgaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacccccaagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggacgggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgcgagaagaucgacggcgugaagcuggaguccaugggcaucuaccagauccuggccaucuacagcacggucgccagcucccucgugcugcuggugagccucggggccaucuccuucuggaugugcagcaacggcucccugcagugccggaucugcaucuga

SEQ ID NO: 1846 - RNA, 1698 nt, Artificial Sequence; identical to SEQ ID NO: 1045
  derived and/or modified CDS sequence (AUadapt) from InfluenzaA__ABO38043__HA

SEQ ID NO: 1847 - RNA, 1701 nt, Artificial Sequence
  derived and/or modified CDS sequence (AUadapt) from InfluenzaA__ABO38054__HA
augaaggcccgccugcucgugcugcugugcgcccucgcggccaccgacgccgacaccaucugcaucggcuaccacgccaacaacucgacggacaccgucgacaccgugcuggagaagaacgugaccgucacgcacuccgugaaccugcucgaggacagccacaacgggaagcugugccggcugaagggcaucgcgccccuccagcuggggaagugcaacaucgccggcuggauccuggggaacccggagugcgagucccuccugucggagcgcuccuggagcuacaucguggagacccccaacuccgagaacgggaccugcuaccccggcgacuucaucgacuacgaggagcugcgggagcagcucucguccgucagcuccuucgagcgcuucgagaucuucucgaaggaguccagcuggcccaagcacaacaccacgcgcggggugaccgccgccugcucccacgccggcaagagcuccuucuaccggaaccugcuguggcucaccgagaaggacgggucguacccgaaccugaacaacuccuacgugaacaagaagggcaaggagguccuggugcucuggggcgugcaccaccccagcaacaucaaggaccagcagacccuguaccagaaggagaacgcguacgucucggugguguccagcaacuacaaccggcgcuucacgcccgagaucgccgagcggcccaagguccgcggccaggccggccggaugaacuacuacuggacccugcucaagccgggggacaccaucauguucgaggccaacggcaaccugaucgcccccugguacgcguucgcccugucccgcggguucggcucgggcaucaucaccuccaacgccagcaugcacgagugcgacacgaagugccagacgccccagggggccaucaacuccucgcuccccuuccagaacauccacccggugaccaucggcgagugccccaaguacgugcgguccaccaagcugcgcauggucaccgggcugcggaacauccccagcauccagucccgcggccucuucggggccaucgcgggcuucaucgagggcggguggaccggcaugaucgacgggugguacggcuaccaccaccagaacgagcaggggagcggcuacgccgccgaccagaaguccacccagaacgccaucaacggcaucaccaacaaggugaacucggugaucgagaagaugaacacgcaguucaccgccgucgggaaggaguucaacaaccuggagaagcggauggagaaccugaacaagaagguggacgacggcuuccucgacaucuggaccuacaacgcggagcugcuggugcuccuggagaacgagcgcacccuggacuuccacgacuccaacgucaagaaccucuacgagaaggugaagaaccagcugcggaacaacgccaaggagaucgggaacggcugcuucgaguucuaccacaagugcaacaacgagugcauggagagcgucaagaacgggacguacgacuaccccaaguacuccgaggagucgaagcugaaccgcgagaagaucgacggcgugaagcucgaguccaugggcguguaccagauccuggccaucuacagcaccgucgccucgucccuggugcuccuggugagccugggggccaucuccuucuggaugugcagcaacggcucccuccagugccggaucugcaucuga

SEQ ID NO: 1848 - RNA, 1701 nt, Artificial Sequence
  derived and/or modified CDS sequence (AUadapt) from InfluenzaA__ABO38065__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagcggagcuggccgaagcacaacaucacccgcggcgucacggccuccugcagccacaagggcaaguccucguucuaccggaaccuccuguggcugaccgagaagaacggguccuaccccaaccucagcaagagcuacgugaacaacaaggagaaggaggugcugguccuguggggcgugcaccaccccuccaacaucgaggaccagaagaccaucuaccgcaaggagaacgccuacgugucggucguguccagcaacuacaaccggcgcuucacccccgagaucgcgaagcggccgaaggugcgcgggcaggagggccggaucaacuacuacuggacgcuccuggagcccggcgacaccaucaucuucgaggccaacgggaaccugaucgcccccugguacgccuucgcccucucccgcggcuucgggagcggcaucaucaccuccaacgcgucgauggacgagugcgacaccaagugccagacgccccagggcgccaucaacuccagccugccguuccagaacguccaccccgugaccaucggggagugccccaaguacgugcgguccaccaagcugcgcauggucaccggccuccggaacauccccagcauccagucccgcgggcuguucggcgccaucgccggguucaucgagggcggcuggacggggaugaucgacggcugguacggguaccaccaccagaacgagcagggcucgggguacgccgcggaccagaaguccacccagaacgccaucaacggcaucaccaacaaggugaacagcgugaucgagaagaugaacacccaguucacggccgucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacuccaacgucaagaaccuguacgagaaggucaagagccagcugaagaacaacgccaaggagaucggcaacgggugcuucgaguucuaccacaagugcaacaacgagugcauggaguccgugaagaacggcaccuacgacuacccgaaguacucggaggagagcaagcucaaccgggagaagaucgacggggugaagcuggaguccaugggcguguaccagauccuggcgaucuacagcacggucgccuccucgcucgugcugcuggugucccucggcgccaucagcuucuggaugugcuccaacgggagccugcagugccgcaucugcaucuga

SEQ ID NO: 1849 - RNA, 1701 nt, Artificial Sequence; identical to SEQ ID NO: 488
  derived and/or modified CDS sequence (AUadapt) from InfluenzaA__ABO38076__HA

SEQ ID NO: 1850 - RNA, 1701 nt, Artificial Sequence
  derived and/or modified CDS sequence (AUadapt) from InfluenzaA__ABO38087__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccagcgccugcaagcggcgcuccaucaagucguucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucucgcuguacgcccaggccagcgggcgcgugaccgucuccaccaagcggucgcagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcucgggcaaguccagcaucaugcgguccaacgccccgaucgggaagugcaacucggagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacgucggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 1851 - RNA, 1689 nt, Artificial Sequence
  derived and/or modified CDS sequence (AUadapt) from InfluenzaA__ABO38098__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccgacaucgccacgcggcccaaggugaacggccagggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucggcaacugcgagaccaagugccagaccccgcugggggccaucaacacgacccugcccuuccacaacgugcacccccucaccaucggcgagugccccaaguacgucaagucggagaagcuggugcuggcgaccgggcuccgcaacgugccgcagaucgagucccggggccuguucggggccaucgccggcuucaucgagggcggguggcagggcauggucgacgggugguacggcuaccaccacucgaacgaccagggguccggcuacgccgccgacaaggagucgacgcagaaggcguucgacggcaucaccaacaaggugaacuccgugaucgagaagaugaacacccaguucgaggccgucgggaaggaguucagcaaccuggagcgccggcucgagaaccugaacaagaagauggaggacggcuuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucgggaacggcugcuucgaguucuaccacaagugcgacgacgagugcaugaacucggugaagaacggcaccuacgacuaccccaaguacgaggaggaguccaagcugaaccggaacgagaucaagggggugaagcugucguccaugggcgucuaccagauccucgccaucuacgccaccguggcggggucgcugucccuggccaucaugauggccggcaucucguucuggaugugcuccaacgggagccuccagugccgcaucugcaucuga

SEQ ID NO: 1852 - RNA, 1701 nt, Artificial Sequence
  derived and/or modified CDS sequence (AUadapt) from InfluenzaA__ABO38230__HA
augaagaccaucaucgcccugucguacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccucgaccgggcgcaucugcgacaacccccaccggauccuggacggcaagaacugcacccucaucgacgcccugcugggggacccccacugcgacggcuuccagaacgagaagugggaccucuucguggagcgcuccaaggccuucagcaacugcuaccccuacgacgugccggacuacgcgucccugcggucgcuggucgccuccagcggcacgcucgaguucuucaacgagggguucaacuggaccggcgugacccagaacgggggcuccuacgccugcaagcgcgggcccgacaacagcuucuucucccggcugaacuggcuguacaagucggaguccaccuaccccgugcucaacgucacgaugcccaacaacgacaacuucgacaagcuguacaucuggggcgugcaccacccgagcaccgacaaggagcagaccaaccuguacgugcaggccuccggccgcgucaccgugucgacgaagcggucccagcagaccaucauccccagcguggggucgcgccccuggguccggggccucuccagccgcaucuccaucuacuggaccaucgugaagcccggggacgugcugcugaucaacagcaacggcaaccucaucgcgccgcggggcuacuucaagauccgcaccgggaaguccucgaucaugcgguccgacgcccccaucggcacgugcagcuccgagugcaucacccccaacgggucgauccccaacgacaagccguuccagaacgucgacaagaucaccuacggcgccugccccaaguacgugaagcagaacacccugaagcuggccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccucuggucguacaacgcggagcugcuggucgcccucgagaaccagcacaccaucgaccugaccgacuccgagaugaacaagcuguucgagaagacgcggcgccagcuccgggagaacgccgaggacauggggaacggcugcuucaagaucuaccacaagugcgacaacgccugcaucgggagcauccgcaacggcaccuacgaccacgacguguaccgcgacgaggcccugaacaaccgguuccagaucaagggcgucgagcugaaguccggguacaaggacuggauccucuggaucagcuucgcgaucuccugcuuccugcugugcguggugcuccugggcuucaucaugugggccugccagaaggggaacauccgcugcaacaucugcaucuga

SEQ ID NO: 1853 - RNA, 1701 nt, Artificial Sequence
  derived and/or modified CDS sequence (AUadapt) from InfluenzaA__ABO38241__HA
augaagaccaucaucgcccugucguacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccucguccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucucgaacugcuaccccuacgacgugccggacuacgcgucccugcggagccucgucgccuccucgggcacgcuggaguucaucaacgagggguucaacuggaccggcgugacccaguccgggggcagcuacacgugcaagcgcggguccgugaacucguucuucucccggcugaacuggcucuacgagagcgaguccaaguaccccgcccugaacgucaccaugcccaacaacggcaaguucgacaagcuguacaucuggggcgugcaccaccccucgaccgacaaggagcagaccaaccucuacgugcgcgccagcgggcgggucaccguguccacgaagcgcucgcagcagaccgugaucccgaacaucggcccccggcccuggguccgcgggcuguccagccggaucuccaucuacuggaccaucgugaagcccggcgacauccugcucaucaacucgaccggcaaccugaucgcgccgcgcggguacuucaagauccggacgggcaaguccagcaucaugcgcuccgacgcccccaucgggaccugcucguccggcugcaucacccccaacgggagcauccccaacgacaagccguuccagaacgugaacaagaucaccuacggcgccugcccccgguacgucaagcagaacacgcugaagcucgccaccggcaugcgcaacgugcccgagaagcagacccgggggaucuucggcgccaucgcgggguucaucgagaacggcugggaggggaugguggacggcugguacggcuuccgccaccagaacuccgaggggaccggccaggccgccgaccucaagucgacgcaggccgccaucgaccagaucaacgggaagcugaaccggcucaucgagaagaccaacgagaaguuccaccagaucgagaaggaguucuccgaggucgagggccgcauccaggaccuggagaaguacguggaggacaccaagaucgaccuguggagcuacaacgcggagcuccugguggcccuggagaaccagcacaccaucgacaugacggacuccgagaugaacaagcuguucgagaagacccggaagcagcugcgcgagaacgccgaggacauggggaacggcugcuucaagaucuaccacaagugcgacaacgccugcaucggcucgauccgcaacgggaccuacgaccacgacgucuaccgggacgaggcccugaacaaccgcuuccagaucaagggcguggagcucaaguccggguacaaggacuggauccuguggaucagcuucgcgaucagcugcuuccugcucugcgucgugcugcugggcuucaucaugugggccugccagaagggcaacauccggugcaacaucugcaucuga

SEQ ID NO: 1854 - RNA, 1701 nt, Artificial Sequence; identical to SEQ ID NO: 527
  derived and/or modified CDS sequence (AUadapt) from InfluenzaA__ABO38252__HA

SEQ ID NO: 1855 - RNA, 1689 nt, Artificial Sequence
  derived and/or modified CDS sequence (AUadapt) from InfluenzaA__ABO38296__HA
auggugaucaucuaccugauccuccuguucaccgccguccgcggcgaccagaucugcaucggguaccacgccaacaacucgaccgagaagguggacacgauccuggagcggaacgugaccgucacccacgcgaaggacauccucgagaagacccacaacggcaagcugugcaagcugaacgggaucccgccccucgagcugggcgacugcuccaucgccggguggcugcucggcaaccccgagugcgaccgccugcugucggugcccgagugguccuacaucauggagaaggagaacccccgggacggccucugcuacccggggagcuucaacgacuacgaggagcugaagcacuuccuguccucggugaagcacuucgagaaggucaagauccuccccaaggaccgcuggacgcagcacaccaccaccggcgggucccgggccugcgccgugucgggcaaccccuccuucuuccgcaacaugguguggcugacgaagaaggggagcaacuaccccgucgccaagggcuccuacaacaacaccucgggcgagcagaugcugaucaucuggggcgugcaccacccgaacgacgagaccgagcagcggacccucuaccagaacguggggacguacgucuccguggggaccucgacccugaacaagcgcuccacccccgacaucgcgacgcggcccaaggugaacggccugggcgggcgcauggaguucagcuggacccuccuggacaugugggacaccaucaacuucgaguccaccggcaaccugaucgcccccgaguacggguucaagaucucgaagcggggcuccucggggaucaugaagacggagggcacccucggcaacugcgagaccaagugccagaccccgcugggggccaucaacacgacccugcccuuccacaacguccacccccucaccaucggcgagugccccaaguacgucaagagcgagaagcuggugcuggccaccgggcuccgcaacgugccgcagaucgagucccggggccuguucggggcgaucgccggcuucaucgagggcggguggcagggcaugguggacgggugguacggcuaccaccacucgaacgaccagggguccggcuacgccgccgacaaggagucgacgcagaaggccuucgacggcaucaccaacaaggugaacuccgucaucgagaagaugaacacccaguucgaggcgguggggaaggaguucagcaaccuggagcgccggcucgagaaccugaacaagaagauggaggacggcuuccuggacguguggaccuacaacgccgagcuccugguccugauggagaacgagcgcacgcucgacuuccacgacuccaacgugaagaaccuguacgacaagguccggaugcagcugcgcgacaacgccaaggagcucgggaacggcugcuucgaguucuaccacaagugcgacgacgagugcaugaacucggugaagaacggcaccuacuacuaccccaaguacgaggaggaguccaagcugaaccggaacgagaucaagggggugaagcugucguccaugggcgucuaccagauccucgccaucuacgccaccguggcggggagccugucccuggccaucaugauggccggcaucucguucuggaugugcuccaacgggagccuccagugccgcaucugcaucuga

SEQ ID NO: 1856 - RNA, 1698 nt, Artificial Sequence; identical to SEQ ID NO: 1115
  derived and/or modified CDS sequence (AUadapt) from InfluenzaA__ABO38318__HA

SEQ ID NO: 1857 - RNA, 1698 nt, Artificial Sequence; identical to SEQ ID NO: 1045
  derived and/or modified CDS sequence (AUadapt) from InfluenzaA__ABO38329__HA

SEQ ID NO: 1858 - RNA, 1701 nt, Artificial Sequence
  derived and/or modified CDS sequence (AUadapt) from InfluenzaA__ABO38351__HA
augaaggcccgccugcucgugcugcugugcgcccucgcggccaccgacgccgacaccaucugcaucggcuaccacgccaacaacucgacggacaccgucgacaccgugcuggagaagaacgugaccgucacgcacuccgugaaccugcucgaggacagccacaacgggaagcugugccggcugaagggcaucgcgccccuccagcuggggaagugcaacaucgccggcuggcugcucgggaacccggagugcgacccccugcugcccgcccgcuccuggucguacaucguggagacccccaacuccgagaacggcaucugcuacccgggcgccuucaucgacuacgaggagcuccgggagcagcugagcuccgucucguccuucgagcgcuucgagaucuuccccaaggagagcuccuggcccaaccacaacaccaacaucggggugaccgccgcgugcucgcacgccggcaaguccagcuucuaccggaaccugcucuggcugacgaagaagggcggguccuaccccaagcugaagaacagcuacgugaacaagaaggggaaggagguccucgugcuguggggcauccaccacccguccaacucgaaggaccagcagacccuguaccagaacgagaacgccuacguguccgucgugagcucgaacuacaaccgccgguucacccccgagaucgccgagcgccccgaggugcgggaccaggccggccgcaugaacuacuacuggacccuccuggagcccggggacacgaucauguucgaggcgaacggcaaccuggucgccccgugguacgccuucgcccucucccggggguucggcagcggcaucaucaccuccaacgccucgaugcacgagugcaacaccaagugccagacgccccagggggcgaucaacuccagccugcccuuccagaacauccaccccgugaccaucggcgagugcccgaaguacgugcgcuccgccaagcugcggauggucaccgggcuccgcaacauccccucgauccagucccggggccuguucggggccaucgccggcuucaucgagggcggguggaccggcaugaucgacgggugguacggcuaccaccaccagaacgagcaggggagcggcuacgccgcggaccagaaguccacccagaacgccaucaacggcaucacgaacaaggugaacagcgugaucgagaagaugaacacccaguucaccgccgucgggaaggaguucaacaaccuggagaagcgcauggagaaccucaacaagaagguggacgacggcuuccuggacaucuggaccuacaacgccgagcugcucgugcugcuggagaacgagcggacgcucgacuuccacgacuccaacgucaagaaccuguacgagaaggucaagucgcagcugaagaacaacgccaaggagaucgggaacggcugcuucgaguucuaccacaagugcgacaacgagugcauggaguccgugcgcaacgggaccuacgacuaccccaaguacagcgaggaguccaagcucaaccgggagaagaucgacggcgugaagcuggagucgaugggcguguaccagauccuggcgaucuacuccaccgucgccagcucgcucgugcugcuggugucccucggggccaucagcuucuggaugugcuccaacggcagccugcagugccgcaucugcaucuga

SEQ ID NO: 1859 - RNA, 1701 nt, Artificial Sequence
  derived and/or modified CDS sequence (AUadapt) from InfluenzaA__ABO38362__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucgugucgaagaaguccuggagcuacaucgccgagacccccaacuccgagaacgggaccugcuaccccggcuacuucgccgacuacgaggagcugcgggagcagcugagcuccgucucguccuucgagcgcuucgagaucuuccccaaggagagcuccuggccgaagcacaacgugacccgcggggugacggccagcugcucccacaagggcaagucguccuucuaccggaaccuccuguggcugaccgagaagaacgggagcuaccccaaccucagcaaguccuacgucaacaacaaggagaaggaggugcuggugcuguggggcguccaccaccccucgaacaucgagaaccagaagaccaucuaccggaaggagaacgccuacguguccguggucagcucccacuacaaccgccgguucacccccgagaucgcgaagcgcccgaaggugcgggaccaggaggggcgcaucaacuacuacuggacgcuccuggagcccggcgacaccaucaucuucgaggccaacggcaaccugaucgcccccugguacgccuucgcccucagccggggguucggcuccgggaucaucaccucgaacgcguccaucgacgagugcgacgccaagugccagacgccccagggcgccaucaacagcucccugccguuccagaacgugcaccccgucaccaucggcgagugccccaaguacgugcgcagcaccaagcugcggauggugaccgggcuccgcaacauccccuccauccagucgcggggccuguucggggccaucgccggcuucaucgagggcggcuggaccggcaugaucgacgggugguacggcuaccaccaccagaacgagcagggguccggcuacgcggccgaccagaaguccacgcagaacgccaucaacgggaucaccaacaaggucaacagcgugaucgagaagaugaacacccaguucaccgccgugggcaaggaguucaacaagcuggagaagcgcauggagaaccucaacaagaaggucgacgacggcuuccuggacaucuggacguacaacgccgagcugcucgugcugcuggagaacgagcggacccucgacuuccacgacagcaacgucaagaaccuguacgagaaggugaagucccagcugaagaacaacgcgaaggagaucgggaacggcugcuucgaguucuaccacaagugcaacaacgagugcauggagucggugaagaacgggaccuacgacuacccgaaguacagcgaggaguccaagcucaaccgcgagaagaucgacggcgucaagcuggagagcauggggguguaccagauccuggccaucuacuccaccguggccucgucccucguccugcuggugagccucggcgccaucuccuucuggaugugcagcaacggcucccugcagugccggaucugcaucuga

SEQ ID NO: 1860 - RNA, 1698 nt, Artificial Sequence
  derived and/or modified CDS sequence (AUadapt) from InfluenzaA__ABO38373__HA
augaaggcccgccugcucgugcugcugugcgcccucgcggccaccgacgccgacaccaucugcaucggcuaccacgccaacaacucgacggacaccgucgacaccgugcuggagaagaacgugaccgucacgcacuccgugaaccugcucgaggacagccacaacgggaagcugugccggcugaagggcaucgcgccccuccagcuggggaagugcaacaucgccggcuggauccuggggaacccggagugcgagucccuccugucggagcgcuccuggagcuacaucguggagacccccaacuccgagaacgggaccugcuaccccggcgacuucaucgacuacgaggagcugcgggagcagcucucguccgucagcuccuucgagcgcuucgagaucuucucgaaggaguccagcuggcccaagcacaccaccgggggcgugaccgccgccugcucccacgccggcaagucguccuucuaccggaaccugcuguggcucaccgagaaggacggcagcuacccgaaccugaacaacuccuacgugaacaagaaggggaaggagguccuggugcucuggggcgugcaccaccccucgaacaucaaggaccagcagacccuguaccagaaggagaacgcguacgucagcgugguguccucgaacuacaaccgccgguucacgcccgagaucgccgagcgccccaagguccggggccaggccgggcgcaucaacuacuacuggacccugcucaagccgggcgacaccaucauguucgaggccaacgggaaccugaucgcccccugguacgcguucgcccugucccggggcuucggcagcgggaucaucaccuccaacgccucgaugcacgagugcgacacgaagugccagacgccccagggcgccaucaacuccagccuccccuuccagaacauccacccggugaccaucggggagugccccaaguacgugcgcuccaccaagcugcggauggucacgggccugcgcaacauccccucgauccagucccggggccucuucggggccaucgcgggcuucaucgagggcggguggaccgggaugaucgacggcugguacggguaccaccaccagaacgagcagggcagcggcuacgccgccgaccagaaguccacccagaacgccaucaacgggaucaccaacaaggugaacucggugaucgagaagaugaacacgcaguucaccgccgucggcaaggaguucaacaaccuggagaagcgcauggagaaccugaacaagaagguggacgacggguuccucgacaucuggaccuacaacgcggagcugcuggugcuccuggagaacgagcggacccuggacuuccacgacuccaacgucaagaaccucuacgagaaggugaagaaccagcugcgcaacaacgccaaggagaucggcaacgggugcuucgaguucuaccacaagugcaacaacgagugcauggagagcgucaagaacggcacguacgacuaccccaaguacuccgaggagucgaagcugaaccgggagaagaucgacggcgugaagcucgaguccauggggguguaccagauccuggccaucuacagcaccgccgccucgucccugguccuccuggugagccugggcgcgaucuccuucuggaugugcagcaacgggucccuccagugccgcaucugcaucuga

SEQ ID NO: 1861 - RNA, 1701 nt, Artificial Sequence
  derived and/or modified CDS sequence (AUadapt) from InfluenzaA__ABO38384__HA
augaaggcccgccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccggcugaagggcaucccgccccuccagcuggggaagugcaacaucgcgggcuggcugcucgggaaccccgagugcgacucccugcugcccgcccgcucgugguccuacaucguggagacgcccaacagcgagaacggcgccugcuacccgggcgacuucaucaacuacgaggagcuccgggagcagcuguccucggucuccagcuucgagcgcuucgagaucuuccccaaggaguccucguggcccaagcacaacaccaccaagggggugaccgccgcgugcucccacgccggcaagagcuccuucuaccggaaccugcucuggcugacgaagaaggaggacucguaccccaagcugaagaacuccuacgugaacaagaaggggaaggagguccucgugcuguggggcgugcaccacccgagcuccucgaaggagcagcagacccuguaccagaacgagaacgccuacgucagcgugguguccagcaacuacaaccgccgguucacccccgagaucgccgagcgccccaagguccgggaccagaccgggcgcaugaacuacuacuggacgcuccuggagcccggcgacaccaucaucuucgaggccaacggcaaccugaucgcgccgugguacgccuucgcccucucccggggguucggcucggggaucaucaccuccaacgccagcaugcacgagugcaacaccaagugccagacgccccagggcgccaucaacuccucgcugcccuuccagaacauccaccccgugaccaucggcgagugcccgaaguacgugcgcuccgcgaagcugcggauggucaccgggcuccgcaacauccccagcauccagucccggggccuguucggggccaucgccggcuucaucgagggcggguggaccggcaugaucgacgggugguacggcuaccaccaccagaacgagcaggggucgggcuacgccgccgaccagaaguccacgcagaacgcgaucaacgggaucaccaacaaggugaacagcgugaucgagaagaugaacacccaguucaccgccgucggcaaggaguucaacaaccuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagucgcagcugaagaacaacgccaaggagaucgggaacggcugcuucgaguucuaccacaagugcgacaacgagugcauggaguccgugcgcaacgggaccuacgacuaccccaaguacagcgaggaguccaagcucaaccgggagaagaucgacggcgugaagcuggagucgauggggguguaccagauccuggccaucuacagcaccgucgcguccucgcucgugcugcuggugucccucggcgccaucagcuucuggaugugcuccaacggcagccugcagugccgcaucugcaucuga

SEQ ID NO: 1862 - RNA, 1701 nt, Artificial Sequence
  derived and/or modified CDS sequence (AUadapt) from InfluenzaA__ABO38395__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcguguccucguucgagcgcuucgagaucuuccccaaggaguccagcuggccgaaccacacggucaccaagggggugaccgccuccugcagccacaagggccgguccagcuucuaccgcaaccugcucuggcugaccaagaagaacggguccuaccccaaccugucgaagagcuacgugaacaacaaggagaaggagguccucgugcuguggggcgugcaccaccccuccaacaucggggaccagcgggccaucuaccacacggagaacgcguacgucagcgugguguccucgcacuacaaccgccgguucacccccgagaucgccaagcgcccgaagguccgggaccaggagggccgcaucaacuacuacuggacccugcucgagcccggcgacaccaucaucuucgaggccaacgggaaccugaucgcccccugguacgccuucgcgcugucccggggcuucgggagcggcaucaucacguccaacgccagcauggacgagugcgacgccaagugccagacgccccagggcgccaucaacuccucgcucccguuccagaacgugcaccccgugaccaucggggagugccccaaguacguccgcuccaccaagcugcggauggugaccggccugcgcaacauccccagcauccagucccggggccucuucggcgccaucgcgggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgucaucgagaagaugaacacgcaguucaccgccgugggcaaggaguucaacaagcuggagcgccggauggagaaccugaacaagaagguggacgacggguuccucgacaucuggaccuacaacgcggagcugcugguccuccuggagaacgagcgcacccuggacuuccacgacuccaacgugaagaaccucuacgagaaggucaagucgcagcugaagaacaacgccaaggagaucggcaacgggugcuucgaguucuaccacaagugcaacaacgagugcauggaguccgugaagaacggcacguacgacuacccgaaguacagcgaggagagcaagcugaaccgggagaagaucgacggggugaagcucgaguccaugggcgucuaccagauccuggccaucuacucgaccguggccuccagccuggugcuccuggucucccugggcgccaucagcuucuggaugugcuccaacgggagccuccagugccgcaucugcaucuga

SEQ ID NO: 1863 - RNA, 1701 nt, Artificial Sequence
  derived and/or modified CDS sequence (AUadapt) from InfluenzaA__ABO38406__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggucguacaucgccgagacccccaacagcgagaacgggaccugcuaccccggcuacuucgccgacuacgaggagcugcgcgagcagcuguccagcguguccucguucgagcgguucgagaucuuccccaaggaguccagcuggccgaaccacaacgucaccaagggggugacggccuccugcagccacaagggcaaguccagcuucuaccgcaaccuccuguggcugaccgagaagaagggguccuaccccaaccucucgaagagcuacgugaacaacaaggagaaggagguccuggugcuguggggcauccaccaccccuccaacaucgaggaccagaagaccaucuaccggaaggagaacgccuacgugagcgucguguccucgcacuacaaccgccgguucacccccgagaucgcgaagcgcccgaaggugcgggaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccgcggcgccaucaacuccucgcugccguuccagaacguccaccccgugaccaucggcgagugccccaaguacgugcgguccaccaagcugcgcauggucaccgggcuccggaacauccccagcauccagucccgcggccuguucggggccaucgccggcuucaucgagggcggcuggaccggcaugaucgacgggugguacggcuaccaccaccagaacgagcaggggagcggcuacgcggccgaccagaaguccacgcagagcgccaucaacgggaucaccaacaaggugaacuccaucaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacucgaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuacccgaaguacagcgaggaguccaagcucaaccgggagaagaucgacggcgucaagcuggagucgauggggguguaccagauccuggccaucuacuccaccguggccagcucccucguccugcuggugagccucggcgccaucuccuucuggaugugcagcaacggcucccugcagugccgcaucugcaucuga

SEQ ID NO: 1864 - RNA, 1701 nt, Artificial Sequence
  derived and/or modified CDS sequence (AUadapt) from InfluenzaA__ABO38417__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcucccccaccggccgcaucugcgacucgccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcucgcugguggccuccagcggcacccuggaguucaacaacgaguccuucaacuggaccggcguggcccagaacgggaccucguccgccugcaagcggcgcagcaucaaguccuucuucucgcggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggccucggggcgcgugaccgucagcaccaagcggucccagcagacggugauccccaacaucggcucgcgccccugggugcgcggggucuccagccggaucuccaucuacuggaccaucgugaagcccggcgacauccuccugaucaacucgaccggcaaccugaucgccccgcggggguacuucaagauccgcuccggcaagagcuccaucaugcggucgaacacccccaucgggaagugcaacuccgagugcaucacgcccaacggcagcauccccaacgacaagccguuccagaacgugaaccgcaucaccuacggcgccugcccccgguacgucaagcagaacacccucaagcuggcgaccgggaugcgcaacgugcccgagaagcagacgcggggcaucuucggggccaucgccggcuucaucgagaacgggugggagggcaugguggacggcugguacggguuccgccaccagaacuccgagggcaccgggcaggccgccgaccucaagucgacccaggcggccaucaaccagaucaacggcaagcugaaccggcugaucgagaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacaugggcaacggcugcuucaagaucuaccacaagugcgacaacgcgugcaucgggucgauccggaacggcacguacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 1865 - RNA, 1689 nt, Artificial Sequence
  derived and/or modified CDS sequence (AUadapt) from InfluenzaA__ABO38712__HA
auggccaucaucuacuucauccugcuguucaccgccgugcgcggcgaccagaucugcaucggguaccacgcgaacaacucgaccgagaaggucgacacgauccuggagcggaacgugaccgugacccacgccaaggacauccuggagaagacccacaacggcaagcucugcaagcugaacgggaucccgccccuggagcucggcgacugcuccaucgccggguggcugcugggcaaccccgagugcgaccgccuccugcggguccccgaguggucguacaucauggagaaggagaacccccgcuacucccugugcuacccgggcagcuucaacgacuacgaggagcucaagcaccuccuguccucggugaagcacuucgagaaggugcggauccuccccaaggacggguggacgcagcacaccaccuccggcgggagcaaggccugcgccgucuccggcaagucguccuucuuccgcaacaugguguggcugaccaagaaggggcccaacuaccccguggcgaagcggucguacaacaacacguccggcgagcagaugcugaucaucuggggcguccaccacccgaaggacgaggccgagcagcgcgcccucuaccagaagguggggaccuacgugagcgccuccaccucgacccugaacaagcgguccacgcccgagaucgcggcccgccccgaggucaacggccuggggagccggauggaguucuccuggacccuccuggacgugugggacaccaucaacuucgagucgaccggcaaccugguggcccccgaguacggcuucaagaucucgaagcgcggguccagcggcaucaugaagacggaggggacccucggcaacugcgagaccaagugccagaccccgcugggggccaucaacacgacccugcccuuccacaacguccacccccucaccaucggcgagugccccaaguacgugaaguccgagaagcuggugcuggccaccggccuccggaacgucccgcagaucgagucgcgcgggcuguucggcgcgaucgccggguucaucgagggcggguggcagggcaugguggacggcugguacggguaccaccacuccaacgaccagggcagcggguacgccgccgacaaggaguccacgcagaaggccuucgaccggaucaccaacaaggugaacucggucaucgagaagaugaacacccaguucgaggcggugggcaaggaguucuccaaccuggagaagcgccucgagaaccugaacaagaagauggaggacggguuccuggacguguggaccuacaacgccgagcuccugguccugauggagaacgagcggacgcucgacuuccacgacucgaacgugaagaaccuguacaacaagguccgcaugcagcugcgggacaacgugaaggagcucggcaacggcugcuucgaguucuaccacaagugcgacgacgagugcauguccagcgugaagaacgggaccuacgacuaccccaaguacgaggaggaguccaagcugaagcgcaacgagaucaagggcgucaagcugucguccauggggguguaccagauccucgccaucuacgccaccguggccggcagccugucccuggcgaucaugaucgccggcaucucgcucuggaugugcuccaacgggagccugcagugccggaucugcaucuga

SEQ ID NO: 1866 - RNA, 1689 nt, Artificial Sequence
  derived and/or modified CDS sequence (AUadapt) from InfluenzaA__ABO38723__HA
auggccaucaucuacuucauccugcuguucaccgccgugcgcggcgaccagaucugcaucggguaccacgcgaacaacucgaccgagaaggucgacacgauccuggagcggaacgugaccgugacccacgccaaggacauccuggagaagacccacaacggcaagcucugcaagcugaacgggaucccgccccuggagcucggcgacugcuccaucgccggguggcugcugggcaaccccgagugcgaccgccuccugcggguccccgaguggucguacaucauggagaaggagaacccccgcuacucccugugcuacccgggcagcuucaacgacuacgaggagcucaagcaccuccuguccucggugaagcacuucgagaaggugcggauccuccccaaggacggguggacgcagcacaccaccuccggcgggagcaaggccugcgccgucuccggcaagucguccuucuuccgcaacaugguguggcugaccaagaaggggcccaacuaccccguggcgaagcggucguacaacaacacguccggcgagcagaugcugaucaucuggggcguccaccacccgaacgacgaggccgagcagcgcgcccucuaccagaagguggggaccuacgugagcgccuccaccucgacccugaacaagcgguccacgcccgagaucgcggcccgccccgaggucaacggccuggggagccggauggaguucuccuggacccuccuggacgugugggacaccaucaacuucgagucgaccggcaaccugguggcccccgaguacggcuucaagaucucgaagcgcggguccagcggcaucaugaagacggaggggacccucggcaacugcgagaccaagugccagaccccgcugggggccaucaacacgacccugcccuuccacaacguccacccccucaccaucggcgagugccccaaguacgugaaguccgagaagcuggugcuggccaccggccuccggaacgucccgcagaucgagucgcgcgggcuguucggcgcgaucgccggguucaucgagggcggguggcagggcaugguggacggcugguacggguaccaccacuccaacgaccagggcagcggguacgccgccgacaaggaguccacgcagaaggccuucgaccggaucaccaacaaggugaacucggucaucgagaagaugaacacccaguucgaggcggugggcaaggaguucuccaaccuggagaagcgccucgggaaccugaacaagaagauggaggacggcuuccuggacguguggaccuacaacgccgagcuccugguccugauggagaacgagcggacgcucgacuuccacgacucgaacgugaagaaccuguacaacaagguccgcaugcagcugcgggacaacgugaaggagcucggcaacgggugcuucgaguucuaccacaagugcgacgacgagugcauguccagcgugaagaacggcaccuacgacuaccccaaguacgaggaggaguccaagcugaagcgcaacgagaucaagggggucaagcugucguccaugggcguguaccagauccucgccaucuacgccaccguggccggcagccugucccuggcgaucaugaucgccgggaucucgcucuggaugugcuccaacggcagccugcagugccggaucugcaucuga

SEQ ID NO: 1867 - RNA, 1698 nt, Artificial Sequence
  derived and/or modified CDS sequence (AUadapt) from InfluenzaA__ABO44046__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaagaugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacaacgagugcauggagagcgucaagaacgggaccuacgacuaccccaaguacuccgaggagucgaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 1868 - RNA, 1689 nt, Artificial Sequence
  derived and/or modified CDS sequence (AUadapt) from InfluenzaA__ABO44057__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagcuucaacgacuacgaggagcugaagcaccuccuguccucggugaagcacuucgagaaggugaagauccugcccaaggacggguggacgcagcacgagaccgacggcggguccaaggccugcgccgucucgggcaaggcguccuucuuccggaacaugguguggcugaccaagcgcgggcccaacuaccagguggccaagcggagcuacaacaacaccuccggcgagcagaugcucaucaucuggggcguccaccaccccaaggacgaggccgagcagcgcgcccuguaccagaagguggggacguacgugucggcguccaccucgacccugaacaagcgguccaccccggagaucgccgcccgccccgaggucaacggccucgagagccggauggaguucuccuggacgcugcuggacgugugggacaccaucaacuucgagucgaccgggaaccucguggcccccgaguacggcuucaagaucuccaagcgcggcucgagcgggaucaugaagaccgagggcacgcuggggaacugcgagaccaagugccagacgccccugggcgccaucaacaccacccucccguuccacaacguccacccccugaccaucggggagugccccaaguacgugaaguccgagaagcuggugcucgcgaccggccugcggaacgucccccagaucgagucgcgcggccuguucggggccaucgccggcuucaucgagggcggguggcaggggaugguggacggcugguacggcuaccaccacuccaacgaccaggggucgggcuacgccgccgacaaggaguccacccagaaggcguucgaccggaucacgaacaaggugaacagcgucaucgagaagaugaacauccaguucgaggccguggggaaggaguucuccaaccucgagaagcgccuggagaaccugaacaagaagauggaggacggcuuccucgacguguggaccuacaacgccgagcugcugguccucauggagaacgagcggacccuggacuuccacgacucgaacgugaagaaccuguacgacaagguccgcaugcagcuccgggacaacgugaaggagcuggggaacggcugcuucgaguucuaccacaagugcgacgacgagugcaugaacuccgugaagaacggcaccuacgacuacccgaaguacgaggaggagucgaagcugaagcgcaacgagaucaagggggucaagcucuccagcaugggcguguaccagauccuggccaucuacgccacgguggcggggucccugucgcucgccaucaugaucgccggcaucuccuucuggaugugcagcaacggcucccugcagugccgggucugcaucuga

SEQ ID NO: 1869 - RNA, 1701 nt, Artificial Sequence; identical to SEQ ID NO: 501
  derived and/or modified CDS sequence (AUadapt) from InfluenzaA__ABO44079__HA

SEQ ID NO: 1870 - RNA, 1689 nt, Artificial Sequence
  derived and/or modified CDS sequence (AUadapt) from InfluenzaA__ABO44090__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcgacggccucugcuacccgggguccuucaacgacuacgaggagcugaagcaccuccugucguccgugaagcacuucgagaaggugaagauccugcccaaggaccgguggacgcagcacaccaccaccggcgggagccgcgccugcgccgucuccggcaaccccucguucuuccggaacaugaucuggcugacgaagaagggguccaacuaccccguggcgaagggcucguacaacaacaccuccggcgagcagaugcucaucaucuggggcgugcaccacccgaacgacgagaccgagcagcgcacccuguaccagaacgucgggacguacgugucgguggucaccuccacccugaacaagcggagcacccccaagaucgccacgcgccccaaggugaacgggcucggcggccggauggaguucuccuggacccugcuggacaugugggacaccaucaacuucgagucgaccgggaaccucaucgcccccgaguacggcuucaagaucuccaagcgcgggucguccggcaucaugaagacggaggggacccuggagaacugcgagaccaagugccagaccccgcugggcgccaucaacacgacccuccccuuccacaacgugcacccccugaccaucggcgagugccccaaguacgucaagucggagaagcuggugcucgcgaccgggcugcggaacgugccgcagaucgagagccgcggccuguucggggccaucgccggcuucaucgagggcggguggcagggcauggucgacgggugguacggcuaccaccacuccaacgaccaggggucgggcuacgccgccgacaaggaguccacgcagcgggcguucgacgggaucaccaacaaggugaacucggugaucgagaagaugaacacccaguucgaggccgucggcaaggaguucuccaaccucgagcgccggcuggagaaccugaacaagaagauggaggacggccuccuggacguguggaccuacaacgccgagcugcucgugcugauggagaacgagcgcauccuggacuuccacgacucgaacgucaagaaccucuacgacaaggugcggaugcagcugcgcgacaacgucaaggagcuggggaacggcugcuucgaguucuaccacaagugcgacgacgagugcaugaacuccgugaagaacgggacguacgacuaccccaaguacgaggaggagagcaagcucaaccggaacgagaucaagggcgugaagcuguccucgaugggcgucuaccagauccuggccaucuacgccaccguggcggggucccucucgcuggccaucaugauggccggcaucuccuucuggaugugcagcaacgggucccugcagugccgcaucugcaucuga

SEQ ID NO: 1871 - RNA, 1689 nt, Artificial Sequence
  derived and/or modified CDS sequence (AUadapt) from InfluenzaA__ABO44101__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagcuucaacgacuacgaggagcugaagcaccuccuguccucggugaagcacuucgagaaggugaagauccugcccaaggacggguggacgcagcacaagaccgacggcggguccaaggccugcgccgucucgggcaagcccuccuucuuccggaacaugguguggcugaccaagaaggggcccaacuacccgguggcgaagcgcagcuacaacaacaccuccggcgagcagaugcucaucaucuggggcguccaccaccccaacgacgaggccgagcagcgggcccuguaccagaagguggggacguacgugucggccuccaccagcacccugaacaagcgcuccacccccgagaucgcggcccggcccgaggucucgggccucgggucccgcauggaguucucguggacgcugcuggacgugugggacaccaucuccuucgagagcaccggcaaccucguggccccggaguacggcuucaagaucucgaagcggggguccucgggcaucaugaagaccgaggggacgcugggcaacugcgagaccaagugccagacgccccugggggccaucaacaccacccuccccuuccacaacguccacccccugaccaucggcgagugcccgaaguacgugaaguccgagaagcuggugcucgccaccggccugcgcaacgucccccagaucgagagccgggggcuguucggcgcgaucgccggguucaucgagggcggguggcagggcaugguggacggcugguacggguaccaccacuccaacgaccagggcucgggguacgccgccgacaaggaguccacccagaaggccuucgaccgcaucacgaacaaggugaacagcgucaucgagaagaugaacacccaguucgaggcggugggcaaggaguucuccaaccucgagaagcggcuggagaaccugaacaagaagauggaggacggguuccucgacguguggaccuacaacgccgagcugcugguccucauggagaacgagcgcacccuggacuuccacgacucgaacgugaagaaccuguacgacaagguccggaugcagcuccgcgacaacgugaaggagcugggcaacggcugcuucgaguucuaccacaagugcgacgacgagugcaugaacuccgugaagaacgggacguacgacuaccccaaguacgaggaggagucgaagcugaagcggaacgagaucaagggcgucaagcucuccagcauggggguguaccagauccuggccaucuacgccaccguggccggcucccugucgcucgcgaucaugaucgccggcaucuccuucuggaugugcagcaacgggucccugcagugccgcaucugcaucuga

SEQ ID NO: 1872 - RNA, 1701 nt, Artificial Sequence
  derived and/or modified CDS sequence (AUadapt) from InfluenzaA__ABO44123__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcguguccucguucgagcgcuucgagaucuuccccaaggaguccagcuggccgaaccacacggucaccaagggggugaccgccuccugcagccacaagggcaaguccagcuucuaccggaaccugcucuggcugaccaagaagaacggguccuaccccaaccugucgaagagcuacgugaacaacaaggagaaggagguccucgugcuguggggcgugcaccaccccuccaacaucggggaccagcgcgccaucuaccacacggagaacgcguacgucagcgugguguccucgcacuacaaccggcgcuucacccccgagaucgccaagcggccgaagguccgcgaccaggagggccggaucaacuacuacuggacccugcucgagcccggcgacaccaucaucuucgaggccaacgggaaccugaucgcccccugguacgccuucgcgcugucccgcggcuucgggagcggcaucaucacguccaacgccagcauggacgagugcgacgccaagugccagacgccccagggcgccaucaacuccucgcucccguuccagaacgugcaccccgugaccaucggggagugccccaaguacguccgguccaccaagcugcgcauggugaccggccugcggaacauccccagcauccagucccgcggccucuucggcgccaucgcgggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgucaucgagaagaugaacacgcaguucaccgccgugggcaaggaguucaacaagcuggagcggcgcauggagaaccugaacaagaagguggacgacggguuccucgacaucuggaccuacaacgcggagcugcugguccuccuggagaacgagcggacccuggacuuccacgacuccaacgugaagaaccucuacgagaaggucaagucgcagcugaagaacaacgccaaggagaucggcaacgggugcuucgaguucuaccacaagugcaacaacgagugcauggaguccgugaagaacggcacguacgacuacccgaaguacagcgaggagagcaagcugaaccgcgagaagaucgacggggugaagcucgaguccaugggcgucuaccagauccuggccaucuacucgaccguggccuccagccuggugcuccuggucucccugggcgccaucagcuucuggaugugcuccaacgggagccuccagugccggaucugcaucuga

SEQ ID NO: 1873 - RNA, 1701 nt, Artificial Sequence
  derived and/or modified CDS sequence (AUadapt) from InfluenzaA__ABO44134__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcucgaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugucguccgugagcuccuucgagcgcuucgagaucuuccccaaggagcggagcuggccgaagcacaacgucacccgcggcgugacggccuccugcucgcacaagggcaaguccagcuucuaccggaaccuccuguggcugaccgagaagaacggguccuaccccaaccucucgaagagcuacgugaacaacaaggagaaggagguccuggugcuguggggcgugcaccaccccuccaacaucgaggaccagaagaccaucuaccgcaaggagaacgccuacgucagcgugguguccucgaacuacaaccggcgcuucacccccgagaucgcggagcggccgaagguccgcgggcaggccggccggaucaacuacuacuggacgcuccuggagcccggcgacaccaucaucuucgaggccaacgggaaccugaucgcccccuggcacgccuucgcgcucucccgcggcuucgggagcggcaucaucaccuccaacgccagcauggacgagugcgacaccaagugccagacgccccagggcgccaucaacuccucgcugccguuccagaacauccaccccgugaccaucggggagugccccaaguacgugcgguccaccaagcugcgcauggucaccggccuccggaacauccccagcauccagucccgcgggcuguucggcgccaucgccggguucaucgagggcggcuggacggggaugaucgacggcugguacggguaccaccaccagaacgagcagggcucgggguacgcggccgaccagaaguccacccagaacgccaucaacggcaucaccaacaaggugaacagcgugaucgagaagaugaacacccaguucacggccgucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacuccaacgucaagaaccuguacgagaaggucaagagccagcugaagaacaacgcgaaggagaucggcaacgggugcuucgaguucuaccacaagugcaacaacgagugcauggaguccgugaagaacggcaccuacgacuacccgaaguacucggaggagagcaagcucaaccgggagaagaucgacggggugaagcuggaguccaugggcguguaccagauccuggccaucuacagcacggucgccuccucgcucgugcugcuggugucccucggcgccaucagcuucuggaugugcuccaacgggagccugcagugccgcaucugcaucuga

SEQ ID NO: 1874 - RNA, 1701 nt, Artificial Sequence
  derived and/or modified CDS sequence (AUadapt) from InfluenzaA__ABO52071__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucaacuggaccggcgugacccagaacgggaccucguccgccugcaagcgccggagcaacaacuccuucuucucgcgccugaacuggcucacgcaccugaaguucaaguaccccgcccugaacgugaccaugcccaacaacgagaaguucgacaagcucuacaucuggggcguccaccaccccuccaccgacaacgaccagaucucgcuguacgcgcaggccuccgggcggaucaccgugagcacgaagcgcucgcagcagaccgugaucccgaacaucggcucccggccccgcguccgggacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 1875 - RNA, 1701 nt, Artificial Sequence
  derived and/or modified CDS sequence (AUadapt) from InfluenzaA__ABO52225__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagucgugguccuacaucgccgagacccccaaccccgagaacggcacgugcuaccccggcuacuucgccgacuacgaggagcucaaggagcagcugagcuccgucagcuccuucgagcgguucgagaucuucccgaaggagucguccuggcccaaccacaccgugaccaagggggugaccgccagcugcucccacaacggcaagagcuccuucuacaagaaccugcucuggcugacggagaagaacgggcuguaccccaaccucucgaaguccuacgucaacaacaaggagaaggaggugcuggugcuguggggcguccaccaccccagcaacaucggggaccagcgcgccaucuaccacaccgagaacgcguacgugagcguggucuccagccacuacucccggcgcuucaccccggagaucgccaagcggcccaaggugcgcgaccaggagggccggaucaacuacuacuggacccuccuggagcccggcgacacgaucaucuucgaggccaacgggaaccugaucgcccccugguacgccuucgcgcucucgcgcggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcggucgacgaagcugcgcauggugaccgggcuccggaacaucccguccauccagagccgcggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcggcgcauggagaaccucaacaagaaggucgacgacggcuuccuggacaucuggaccuacaacgcggagcugcucgugcugcuggagaacgagcggacgcucgacuuccacgacucgaacgucaagaaccuguacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcucaagcgcgagaagaucgacggcgucaagcuggagagcaugggcguguaccagauccuggccaucuacucgaccguggccuccagccucguccugcuggugucccucggggccaucagcuucuggaugugcuccaacggcagccugcagugccggaucugcaucuga

SEQ ID NO: 1876 - RNA, 1689 nt, Artificial Sequence
  derived and/or modified CDS sequence (AUadapt) from InfluenzaA__ABO52236__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcacuuccuguccagcgugaagcacuucgagaaggugaagauccuccccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccagcggcgagcagaugcugaucaucuggggcguccaccacccgaacgacgagaccgagcagcggacccucuaccagaacguggggacguacguguccgucgggaccucgacccugaacaagcgcuccacccccgacaucgccacgcggcccaaggugaacggccugggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucggcaacugcgagaccaagugccagaccccgcugggggccaucaacacgacccugcccuuccacaacgugcacccccucaccaucggcgagugccccaaguacgucaagucggagaagcuggugcuggcgaccgggcuccgcaacgugccgcagaucgagucccggggccuguucggggccaucgccggcuucaucgagggcggguggcagggcauggucgacgggugguacggcuaccaccacucgaacgaccagggguccggcuacgccgccgacaaggagagcacgcagaaggcguucgacggcaucaccaacaaggugaacuccgugaucgagaagaugaacacccaguucgaggccgucgggaaggaguucucgaaccuggagcgccggcucgagaaccugaacaagaagauggaggacggcuuccuggacguguggaccuacaacgccgagcuccuggugcugauggagaacgagcgcacgcucgacuuccacgacuccaacgucaagaaccuguacgacaaggugcggaugcagcugcgcgacaacgccaaggagcucgggaacggcugcuucgaguucuaccacaagugcgacgacgagugcaugaacucggucaagaacggcaccuacuacuaccccaaguacgaggaggaguccaagcugaaccggaacgagaucaagggggugaagcugagcuccaugggcguguaccagauccucgccaucuacgcgaccgucgccgggucgcugucccuggccaucaugauggccggcaucucguucuggaugugcuccaacgggagccuccagugccgcaucugcaucuga

SEQ ID NO: 1877 - RNA, 1689 nt, Artificial Sequence
  derived and/or modified CDS sequence (AUadapt) from InfluenzaA__ABO52247__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagcuucaacgacuacgaggagcugaagcaccuccuguccucggugaagcacuucgagaaggugaagauccugcccaaggacggguggacgcagcacaagaccgacggcggguccaaggccugcgccgucucgggcaagcccuccuucuuccggaacaugguguggcugaccaagaaggggcccaacuacccgguggcgaagcgcagcuacaacaacaccuccggcgagcagaugcucaucaucuggggcguccaccaccccaacgacgaggccgagcagcgggcccuguaccagaagguggggacguacgugucggccuccaccucgacccugaacaagcgcuccacccccgagaucgcggcccggcccgaggucagcggccucgggucccgcauggaguucucguggacgcugcuggacgugugggacaccaucuccuucgagucgaccggcaaccucguggccccggaguacggcuucaagaucagcaagcggggguccucgggcaucaugaagaccgaggggacgcugggcaacugcgagaccaagugccagacgccccugggggccaucaacaccacccuccccuuccacaacguccacccccugaccaucggcgagugcccgaaguacgugaaguccgagaagcuggugcucgccaccggcccccgcaacgucccccagaucgagucgcgggggcuguucggcgcgaucgccggguucaucgagggcggguggcagggcaugguggacggcugguacggguaccaccacuccaacgaccagggcagcggguacgccgccgacaaggaguccacccagaaggccuucgaccgcaucacgaacaaggugaacucggucaucgagaagaugaacacccaguucgaggcggugggcaaggaguucuccaaccuggagaagcggcucgagaaccugaacaagaagauggaggacggguuccuggacguguggaccuacaacgccgagcuccugguccugauggagaacgagcgcacccucgacuuccacgacucgaacgugaagaaccuguacgacaagguccggaugcagcugcgcgacaacgugaaggagcucggcaacggcugcuucgaguucuaccacaagugcgacgacgagugcaugaacuccgugaagaacgggacguacgacuaccccaaguacgaggaggagagcaagcugaagcggaacgagaucaagggcgucaagcuguccucgauggggguguaccagauccucgccaucuacgccaccguggccggcucccugucgcuggcgaucaugaucgccggcaucuccuucuggaugugcagcaacgggucccuccagugccgcaucugcaucuga

SEQ ID NO: 1878 - RNA, 1701 nt, Artificial Sequence
  derived and/or modified CDS sequence (AUadapt) from InfluenzaA__ABO52258__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagagcuccuggccgaagcacaacgucacccgcggggugacggccagcugcucccacaagggcaagugcagcuucuaccggaaccuccuguggcugaccgagaagaacggguccuaccccaaccucucgaagagcuacgugaacaacaaggagaaggagguccuggugcuguggggcgugcaccaccccuccaacaucgaggaccagaagaccaucuaccggaaggagaacgccuacgucagcgugguguccucgcacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccagggcgccaucaacuccucgcugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcgucaucgagaagaugaacacccaguucaccgccgugggcaaggaguucaacaagcuggagaagcgcauggagaaccucaacaagaagguggacgacggcuuccuggacaucuggacguacaacgccgagcugcucguccugcuggagaacgagcggacccucgacuuccacgacuccaacgugaagaaccuguacgagaaggucaagucgcagcugaagaacaacgcgaaggagaucgggaacggcugcuucgaguucuaccacaagugcaacaacgagugcauggaguccgugaagaacgggaccuacgacuacccgaaguacagcgaggagagcaagcucaaccgcgagaagaucgacggcgugaagcuggaguccaugggggucuaccagauccuggccaucuacucgaccguggccuccagccucgugcugcuggucucccucggcgccaucagcuucuggaugugcuccaacggcagccugcagugccggaucugcaucuga

SEQ ID NO: 1879 - RNA, 1701 nt, Artificial Sequence
  derived and/or modified CDS sequence (AUadapt) from InfluenzaA__ABO52280__HA
augaaggcccgccugcucauccugcugugcgcccucucggcgaccgacgccgacaccaucugcaucggcuaccacgccaacaacuccacggacaccguggacaccguccuggagaagaacgugaccgugacgcacagcgucaaccugcucgaggacucccacaacgggaagcugugccggcugaagggcaucgcgccccuccagcuggggaagugcaacaucgccggcuggauccuggggaacccggagugcgagucgcuccuguccaaccgcagcugguccuacaucgccgagacccccaacucggagaacggcaucugcuaccccggcgacuucgccgacuacgaggagcugcgggagcagcucuccagcguguccagcuucgagcgcuucgagaucuuccccaaggaguccucguggccgaagcacaacaucacccgcggggugaccgucgccugcucccacgccaagaaguccagcuucuacaagaaccugcuguggcucacggaggcgaacggccuguaccccucgcuguccaagagcuacgugaacgaccgggagaaggaggugcucguccuguggggcgugcaccaccccucgaacaucgaggaccagcggacccuguaccgcaaggagaacgccuacguguccgucgugagcuccaacuacaaccggcgcuucacccccgagaucgccgagcggccgaaggugcgcgggcagcccgggcggaugaacuacuacuggacccuccuggagcccggcgacaagaucaucuucgaggccaacggcaaccugaucgcccccugguacgcguucgcccucagccgcgggccgggcuccgggaucaucacgucgaacgccuccauggacgagugcgacaccaagugccagacgccccagggcgccaucaacagcucccugcccuuccagaacauccaccccgucaccaucggcgagugcccgaaguacgugcggucgaccaagcugcgcauggugaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacgggaucacgaacaaggugaacucggugaucgagaagaugaacacccaguucaccgccgucggcaaggaguucaacaagcuggagaagcggauggagaaccucaacaagaagguggacgacggcuuccuggacaucuggaccuacaacgcggagcugcucgugcugcuggagaacgagcgcacgcucgacuuccacgacagcaacgucaagaaccuguacgagaaggugaagaaccagcugcggaacaacgccaaggagaucgggaacggcugcuucgaguucuaccacaagugcgacaacgagugcauggaguccgucaagaacgggaccuacgacuaccccaaguacagcgaggaguccaagcucaaccgcgccaagaucgacggcgugaagcuggagucgauggggguguaccagauccuggccaucuacagcaccgucgccuccucgcucgugcugcuggugucccucggcgcgaucagcuucuggaugugcuccaacggcagccugcagugccgcaucugcaucuga

SEQ ID NO: 1880 - RNA, 1689 nt, Artificial Sequence
  derived and/or modified CDS sequence (AUadapt) from InfluenzaA__ABO52302__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcaacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccucggcgggcgcauggaguucucguggacccugcuggacaugugggacaccaucaacuucgaguccaccggcaaccucaucgcccccgaguacggguucaagaucucgaagcggggcuccucggggaucaugaagacggagggcacccugggcaacugcgagaccaagugccagaccccgcugggggccaucaacacgacccuccccuuccacaacgugcacccccugaccaucggcgagugccccaaguacgucaagagcgagaagcuggugcucgcgaccgggcugcgcaacgugccgcagaucgagucccggggccuguucggggccaucgccggcuucaucgagggcggguggcagggcauggucgacgggugguacggcuaccaccacucgaacgaccagggguccggcuacgccgccgacaaggagucgacgcagaaggcguucgacggcaucaccaacaaggugaacuccgugaucgagaagaugaacacccaguucgaggccgucgggaaggaguucucgaaccucgagcgccggcuggagaaccugaacaagaagauggaggacggcuuccucgacguguggaccuacaacgccgagcugcuggugcucauggagaacgagcgcacgcuggacuuccacgacuccaacgucaagaaccuguacgacaaggugcggaugcagcuccgcgacaacgucaaggagcuggggaacggcugcuucgaguucuaccacaagugcgacgacgagugcaugaacagcgugaagaacggcaccuacgacuaccccaaguacgaggaggaguccaagcugaaccggaacgagaucaagggggugaagcucucguccaugggcaucuaccagauccuggccaucuacgccaccgucgcggggucgcugucccucgccaucaugauggccggcaucucguucuggaugugcuccaacgggagccugcagugccgcaucugcaucuga

SEQ ID NO: 1881 - RNA, 1701 nt, Artificial Sequence
  derived and/or modified CDS sequence (AUadapt) from InfluenzaA__ABO52313__HA
augaagaccaucaucgcccugucguacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcaacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccaacgccugcaagcgggggcccgacagcggcuucuucucccgccugaacuggcucuacaagucgggcuccaccuaccccgugcugaacgucacgaugcccaacaacgacaacuucgacaagcuguacaucuggggcgugcaccacccgagcaccgaccaggagcagaccaaccucuacgugcaggccuccgggcgggucaccgugucgacgaagcgcucccagcagaccaucauccccaacguggggagccggcccuggguccgcggccugucgucccggaucagcaucuacuggaccaucgugaagcccggcgacauccuggugaucaacuccaacgggaaccucaucgcgccgcgcggccacuucaagaugcggaccggcaagucguccaucaugcgcagcgacgcccccaucgggacgugcuccucggagugcaucacccccaacggguccauccccaacgacaagccguuccagaacgucaacaagaucaccuacggcgccugccccaaguacgugaagcagaacacccugaagcuggccacgggcaugcggaacgugcccgagaagcagacccgcgggaucuucggcgccaucgcgggguucaucgagaacggcugggaggggaugaucgacggcugguacggcuuccggcaccgcaacagcgaggggaccggccaggccgccgaccucaaguccacccaggccgccaucgaccagaucaacgggaagcugaaccgggucaucgagaagacgaacgagaaguuccaccagaucgagaaggaguucucggagguggagggccgcauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcggcgccagcuccgggagaacgccgaggacauggggaacggcugcuucaagaucuaccacaagugcgacaacgccugcaucggcuccauccgcaacgggaccuacgaccacgacguguaccgcgacgaggcccugaacaaccgguuccagaucaagggcgucgagcucaagucgggguacaaggacuggauccuguggaucuccuucgcgaucagcugcuuccugcugugcguggugcuccugggcuucaucaugugggccugccagaagggcaacauccgcugcaacaucugcaucuga

SEQ ID NO: 1882 - RNA, 1701 nt, Artificial Sequence
  derived and/or modified CDS sequence (AUadapt) from InfluenzaA__ABO52335__HA
augaagaccaucaucgcccugucguacaucuucugccucgugcugggccaggacuucccccgcaacgacaacuccaccgccacgcugugccucgggcaccacgcggucccgaacggcacccuggugaagaccaucaccaacgaccagaucgaggugacgaacgccaccgagcugguccagagcuccucgaccgggaagaucugcaacaacccccaccggauccucgacggcaucgacugcacccugaucgacgcccugcucggggacccccacugcgacggcuuccagaacgagacgugggaccuguucguggagcgcuccaaggccuucagcaacugcuaccccuacgacgugccggacuacgccucccugcggucgcucgucgcguccagcggcacccuggaguucaucaacgagggguucaccuggaccggcgugacgcagaacgggggcuccaacgccugcaagcgcgggcccgacucgggcuucuucucccggcugaacuggcucuacaagagcggcaacaccuaccccgugcugaacgucaccaugcccaacaacgacaacuucgacaagcuguacaucuggggcgugcaccacccguccaccgaccaggaccagacgucgcucuacgugcaggccuccggccgcgucaccgugagcaccaagcggucccagcagaccgugauccccaacaucgggccccgccccuggguccggggccugucgagccgcaucuccaucuacuggacgaucgugaagccgggcgacauccugcucaucaacucgaacgggaaccugaucgcgccccggggcuacuucaagaugcgcaccgggaaguccagcaucaugcgguccgacgcccccaucgggaccugcaucucggagugcaucacccccaacggguccaucccgaacgacaagcccuuccagaacgugaacaagaucacguacggcgccugccccaaguacgucaagcagaacacccugaagcucgccaccggcaugcgcaacgugcccgagaagcagacccgggggaucuucggcgccaucgccggguucaucgagaacggcugggaggggaugaucgacggcugguacggcuuccgccaccagaacagcgaggggacgggccaggcggccgaccugaaguccacccaggccgccaucgaccagaucaacgggaagcugaaccgggugaucgagaagaccaacgagaaguuccaccagaucgagaaggaguucucggaggucgagggccgcauccaggaccucgagaaguacguggaggacaccaagaucgaccugugguccuacaacgccgagcugcucguggcgcuggagaaccagcacacgaucgaccugaccgacagcgagaugaacaagcuguucgagaagacccggcgccagcuccgggagaacgccgaggacauggggaacggcugcuucaagaucuaccaccgcugcgacaacgccugcaucggcuccauccgcaacgggaccuacgaccacgacgucuaccgggacgaggcccugaacaaccgcuuccagaucaagggcguggagcucaagucgggguacaaggacuggauccuguggaucuccuucgccaucagcugcuuccugcucugcgucgugcugcugggcuucaucaugugggcgugccagaagggcaacauccggugcaacaucugcaucuga

SEQ ID NO: 1883 - RNA, 1701 nt, Artificial Sequence
  derived and/or modified CDS sequence (AUadapt) from InfluenzaA__ABO52346__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucggacugcuaccccuacgacgugccggacuacgcgucccugcgcagccucgucgccuccucgggcacgcuggaguucaucaacgagggguucaacuggaccggcgugacccagaacgggggcuccagcgccugcaagcgggggcccgacaacggcuucuucucccgccugaacuggcucuacaagucgggcuccaccuaccccgugcagaacgucacgaugcccaacaacgacaacucggacaagcuguacaucuggggcgugcaccacccguccaccgacaaggagcagaccgaccuguacgugcaggccagcgggaaggucaccguguccacgaagcggucgcagcagaccgugauccccaacgucgggagccgccccugggugcggggccucuccucgcgcguguccaucuacuggaccaucgucaagcccggcgacauccuggugaucaacagcaacgggaaccugaucgcgccgcggggcuacuucaagaugcgcaccgggaaguccucgaucaugcgguccgacgcccccaucggcacgugcucguccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcucgauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccgcugcaacaucugcaucuga

SEQ ID NO: 1884 - RNA, 1701 nt, Artificial Sequence
  derived and/or modified CDS sequence (AUadapt) from InfluenzaA__ABO52357__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucuucgagugcaucacccccaacgggucgauccccaacgacaagccguuccagaacgucaacaagaucaccuacggcgccugccccaaguacgugaagcagaacacccugaagcucgccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccucgagaaguacguggaggacaccaagaucgaccuguggucguacaacgcggagcugcucgucgcccuggagaaccagcacaccaucgaccugaccgacuccgagaugaacaagcuguucgagaagacgcggcgccagcugcgggagaacgccgaggacauggggaacggcugcuucaagaucuaccacaagugcgacaacgccugcaucgagagcauccgcaacggcaccuacgaccacgacguguaccgcgacgaggcccugaacaaccgguuccagaucaagggggucgagcucaaguccggcuacaaggacuggauccuguggaucagcuucgcgaucuccugcuuccugcucugcguggugcugcugggguucaucaugugggccugccagcgcggcaacauccggugcaacaucugcaucuga

SEQ ID NO: 1885 - RNA, 1701 nt, Artificial Sequence
  derived and/or modified CDS sequence (AUadapt) from InfluenzaA__ABO52368__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagucguccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 1886 - RNA, 1701 nt, Artificial Sequence
  derived and/or modified CDS sequence (AUadapt) from InfluenzaA__ABO52797__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggucguacaucgccgagacccccaacagcgagaacgggaccugcuaccccggcuacuucgccgacuacgaggagcugcgcgagcagcuguccagcguguccagcuucgagcgguucgagaucuuccccaaggaguccucguggccgaaccacaacgucaccaagggggugacggccuccugcagccacaagggcaaguccagcuucuaccgcaaccuccuguggcugaccgagaagaacggguccuaccccucgcucagcaaguccuacgugaacaacaaggagaaggagguccuggugcuguggggcgugcaccaccccagcaacaucaaggaccagaagaccaucuaccggaaggagaacgccuacgucuccguggugagcucccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucucgcggggguucggcuccgggaucaucaccagcaacgcguccauggacgagugcgacgccaagugccagacgccccagggcgccaucaacagcucccugccguuccagaacgugcaccccgugaccaucggcgagugccccaaguacguccgcucgaccaagcugcggauggugaccgggcuccgcaacauccccuccauccagagccggggccuguucggggccaucgccggcuucaucgagggcggcuggaccggcaugaucgacgggugguacggcuaccaccaccagaacgagcagggguccggcuacgcggccgaccagaaguccacgcagagcgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagucgcagcugaagaacaacgcgaaggagaucgggaacggcugcuucgaguucuaccacaagugcaacaacgagugcauggagagcgugaagaacgggaccuacgacuacccgaaguacuccgaggagagcaagcucaaccgcgagaagaucgacggcgugaagcuggaguccauggggguguaccagauccuggccaucuacucgaccgucgccuccagccucgugcugcuggugucccucggcgccaucagcuucuggaugugcuccaacggcagccugcagugccggaucugcaucuga

SEQ ID NO: 1887 - RNA, 1698 nt, Artificial Sequence; identical to SEQ ID NO: 987
  derived and/or modified CDS sequence (AUadapt) from InfluenzaA__ABP49217__HA

SEQ ID NO: 1888 - RNA, 1698 nt, Artificial Sequence
  derived and/or modified CDS sequence (AUadapt) from InfluenzaA__ABP49305__HA
augaaggccaagcugauggugcuccugugcaccuucaccgccacguacgcggacaccaucugcaucggcuaccacgccaacaacucgaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagcugcucaucagcaaggaguccuggagcuacaucgucgagacccccaaccccgagaacggcacgugcuaccccggcuacuucgccgacuacgaggagcugcgcgagcagcuguccucgguguccagcuucgagcgguucgagaucuucccgaaggaguccagcuggcccaaccacaccgugaccggggucuccgccagcugcucccacaacggcaagucguccuucuaccgcaaccuccuguggcugaccgggaagaacggccucuaccccaaccugagcaaguccuacgccaacaacaaggagaaggaggugcuggugcucuggggcguccaccacccgcccaacaucggggaccagcgggcccuguaccacacggagaacgccuacgugagcguggucagcucccacuacucgcgccgguucacccccgagaucgcgaagcgccccaaggugcgggaccaggagggccgcaucaacuacuacuggacccugcucgagcccggggacaccaucaucuucgaggccaacggcaaccugaucgccccgugguacgccuucgcccugucccggggguucggcagcggcaucaucacguccaacgcgcccaugggggagugcgacgccaagugccagacgccccagggcgccaucaacagcucccuccccuuccagaacgugcacccggucaccaucggggagugccccaaguacgugcgcagcgccaagcugcggauggugaccggccugcgcaacauccccuccauccagucgcggggccucuucggggccaucgcgggcuucaucgagggcggguggaccgggauggucgacggcugguacggguaccaccaccagaacgagcagggcuccggcuacgccgccgaccagaaguccacccagaacgccaucaacgggaucaccaacaaggugaacagcgugaucgagaagaugaacacccaguucacggccgucggcaaggaguucaacaagcuggagcgccggauggagaaccugaacaagaagguggacgacggguuccucgacaucuggaccuacaacgcggagcugcugguccuccuggagaacgagcgcacccuggacuuccacgacagcaacgugaagaaccucuacgagaaggugaagucccagcugaagaacaacgccaaggagaucggcaacgggugcuucgaguucuaccacaagugcaacaacgagugcauggagagcgucaagaacggcaccuacgacuaccccaaguacuccgaggagucgaagcugaaccgggagaagaucgacggcgugaagcucgaguccauggggguguaccagauccuggccaucuacagcacggucgccagcucccuggugcuccuggugagccugggcgccaucuccuucuggaugugcagcaacgggucccuccagugccgcaucugcaucuga

SEQ ID NO: 1889 - RNA, 1701 nt, Artificial Sequence
  derived and/or modified CDS sequence (AUadapt) from InfluenzaA__ABP49316__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagucgcucuucuccaagaaguccuggagcuacaucgccgagacccccaacucggagaacgggaccugcuaccccggcuacuucgccgacuacgaggagcugcgggagcagcuguccagcguguccucguucgagcgcuucgagaucuuccccaaggagcgguccuggccgaagcacaacaucacccgcggcgucacggccgccugcagccacaagggcaaguccagcuucuaccggaaccuccuguggcugaccgagaagaacggguccuaccccaaccucaagaaguccuacgugaacaacaaggagaaggaggugcugguccuguggggcgugcaccaccccucgaacaucgaggaccagaagacccucuaccgcaaggagaacgcguacgugagcgucgugucguccaacuacaacaagcgguucacccccgagaucgccgagcgcccgaaggugcgggggcaggccggccgcaucaacuacuacuggacgcugcuggagcccggcgacaccaucaucuucgaggccaacgggaaccucaucgcccccuggcacgcguucgcccugagccggggcuucggguccggcaucaucaccucgaacgccuccauggacgagugcgacaccaagugccagacgccccagggcgccaucaacagcucccugccguuccagaacauccaccccgucaccaucggggagugccccaaguacgugcgcucgaccaagcuccggauggugaccggccugcgcaacauccccuccauccagagccgggggcuguucggcgccaucgcgggguucaucgagggcggcuggacggggaugaucgacggcugguacggguaccaccaccagaacgagcagggcuccggguacgccgccgaccagaaguccacccagaacgccaucaacggcaucaccaacaaggucaacagcgugaucgagaagaugaacacccaguucacggccgugggcaaggaguucaacaagcucgagaagcgcauggagaaccugaacaagaaggucgacgacggguuccuggacaucuggaccuacaacgcggagcuccuggugcugcucgagaacgagcggacccuggacuuccacgacucgaacgugaagaaccuguacgagaaggucaagucccagcucaagaacaacgccaaggagaucggcaacgggugcuucgaguucuaccacaagugcaacaacgagugcauggagagcgugaagaacggcaccuacgacuacccgaaguacuccgaggagucgaagcugaaccgcgagaagaucgacggggucaagcuggaguccaugggcguguaccagauccucgccaucuacagcacgguggccucgucccugguccugcucgugagccugggcgccaucuccuucuggaugugcagcaacgggucccugcagugccggaucugcaucuga

SEQ ID NO: 1890 - RNA, 1701 nt, Artificial Sequence
  derived and/or modified CDS sequence (AUadapt) from InfluenzaA__ABP49327__HA
augaaggcccgccugcucgugcugcugugcgcccucgcggccaccgacgccgacaccaucugcaucggcuaccacgccaacaacucgacggacaccgucgacaccgugcuggagaagaacgugaccgucacgcacuccgugaaccugcucgaggacagccacaacgggaagcugugccggcugaagggcaucgcgccccuccagcugcgcaagugcaacaucgccggguggauccugggcaacccggagugcgagucccuccugucggagcgguccuggagcuacaucguggagacccccaacuccgagaacgggaccugcuaccccggcgacuucaccaacuacgaggagcugcgcgagcagcucucguccgucagcuccuucgagcgguucgagaucuuccccaaggagucguccuggccgaagcacaacacgacccgcggcgugaccgccgccugcagccacgccgggaaguccucguucuaccggaaccugcuguggcucaccgagaaggacggcuccuaccccaaccugaacaacagcuacgugaacaagaaggggaaggagguccuggugcucuggggcgugcaccaccccuccaacaucaaggaccagcagacgcuguaccagaaggagaacgcguacgucucgguggugagcuccaacuacaaccgccgguucacccccgagaucgccgagcgcccgaagguccgggggcaggccggccgcaugaacuacuacuggacccugcucaagcccggcgacaccaucauguucgaggccaacgggaaccugaucgcccccugguacgcguucgcccugucgcggggcuucggguccggcaucaucacgagcaacgccuccaugcacgagugcgacaccaagugccagacgccccagggcgccaucaacucgucccucccguuccagaacauccaccccgugaccaucggggagugccccaaguacgugcgcagcaccaagcugcggauggucaccggccugcgcaacauccccuccauccagucgcggggccucuucggggccaucgcgggguucaucgagggcggcuggaccgggaugaucgacggcugguacggguaccaccaccagaacgagcagggcuccggguacgccgccgaccagaaguccacccagaacgccaucaacggcaucacgaacaaggugaacagcgugaucgagaagaugaacacccaguucaccgccgucggcaaggaguucaacaaccuggagaagcgcauggagaaccugaacaagaagguggacgacggguuccucgacaucuggaccuacaacgcggagcugcugauccuccuggagaacgagcggacgcuggacuuccacgacucgaacgugaagaaccucuacgagaaggucaagucccagcugcgcaacaacgccaaggagaucggcaacgggugcuucgaguucuaccacaagugcaacaacgagugcauggagagcgugaagaacggcaccuacgacuacccgaaguacuccgaggagucgaagcugaaccgggagaagaucgacggggucaagcucgaguccaugggcguguaccagauccuggccaucuacagcaccguggccucgucccugguccuccuggugagccugggcgccaucuccuucuggaugugcagcaacgggucccuccagugccgcaucugcaucuga

SEQ ID NO: 1891 - RNA, 1701 nt, Artificial Sequence
  derived and/or modified CDS sequence (AUadapt) from InfluenzaA__ABP49338__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagcggagcuggccgaagcacaacgucacccgcggcgugacggccuccugcagccacaagggcaaguccucguucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucucggugguguccagcaacuacaaccggcgcuucacccccgagaucgcgaagcggccgaagguccgcgggcaggagggccggaucaacuacuacuggacgcuccuggagcccggcgacaccaucaucuucgaggccaacgggaaccugaucgcccccugguacgccuucgcccucucccgcggcuucgggagcggcaucaucaccuccaacgcgucgauggacgagugcgacaccaagugccagacgccccagggcgccaucaacuccagccugccguuccagaacgugcaccccgugaccaucggggagugccccaaguacguccgguccaccaagcugcgcauggugaccggccuccggaacauccccagcauccagucccgcgggcuguucggcgccaucgccggguucaucgagggcggcuggacggggaugaucgacggcugguacggguaccaccaccagaacgagcagggcucgggguacgccgcggaccagaaguccacccagaacgccaucaacggcaucaccaacaaggugaacagcgucaucgagaagaugaacacccaguucacggccgugggcaaggaguucaacaagcuggagaagcggauggagaaccucaacaagaagguggacgacggguuccuggacaucuggaccuacaacgccgagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacaacgagugcauggaguccgugaagaacggcaccuacgacuacccgaaguacucggaggagagcaagcucaaccgggagaagaucgacggggugaagcuggaguccaugggcgucuaccagauccuggcgaucuacagcacgguggccuccucgcucgugcugcuggucucccucggcgccaucagcuucuggaugugcuccaacgggagccugcagugccgcaucugcaucuga

SEQ ID NO: 1892 - RNA, 1701 nt, Artificial Sequence
  derived and/or modified CDS sequence (AUadapt) from InfluenzaA__ABP49349__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggucguacaucgccgagacccccaacagcgagaacgggaccugcuaccccggcuacuucgccgacuacgaggagcugcgcgagcagcuguccagcguguccagcuucgagcgguucgagaucuuccccaaggaguccucguggccgaaccacaacgucaccaagggggugacggccuccugcagccacaagggcaaguccagcuucuaccgcaaccuccuguggcugaccgagaagaacggguccuaccccaaccucagcaagucguacgugaacaacaaggagaaggagguccuggugcuguggggcauccaccaccccuccaacaucgaggaccagaagaccaucuaccggaaggagaacgccuacgugagcgucguguccagccacuacaaccgccgguucacccccgagaucgcgaagcgcccgaaggugcgggaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgucgauggacgagugcgacgccaagugccagacgccccugggcgccaucaacuccagccugccguuccagaacguccaccccgugaccaucggcgagugccccaaguacgugcgcuccaccaagcuccggauggucaccgggcugcgcaacauccccagcauccagucccggggccuguucggggccaucgccggcuucaucgagggcggcuggaccggcaugaucgacgggugguacggcuaccaccaccagaacgagcaggggagcggcuacgcggccgaccagaaguccacgcagucggccaucaacgggaucaccaacaaggugaacuccaucaucgagaagaugaacacccaguucaccgccgugggcaaggaguucaacaagcucgagaagcgcauggagaaccugaacaagaaggucgacgacggcuuccuggacaucuggacguacaacgccgagcuccuggugcugcucgagaacgagcggacccuggacuuccacgacagcaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuacccgaaguacagcgaggaguccaagcugaaccgcgagaagaucgacggcgucaagcuggagucgauggggguguaccagauccucgccaucuacuccaccguggccagcucccugguccugcucgugagccugggcgccaucuccuucuggaugugcagcaacggcucccugcagugccggaucugcaucuga

SEQ ID NO: 1893 - RNA, 1701 nt, Artificial Sequence
  derived and/or modified CDS sequence (AUadapt) from InfluenzaA__ABP49360__HA
augaaggccaagcugcucauccugcugugcgccuucaccgcgaccgacgccgacacgaucugcaucggcuaccacgccaacaacucgaccgacaccguggacaccguccucgagaagaacgugacggugacccacuccgucaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcguguccucguucgagcgcuucgagaucuuccccaaggaguccagcuggccgaaccacacggugaccaagggggucaccgccuccugcagccacaacggcaaguccagcuucuaccggaaccugcucuggcugaccaagaagaacggguccuaccccaaccugucgaagagcuacgugaacaacaaggagaaggaggugcucguccuguggggcgugcaccaccccuccaacaucggggaccagcgcgccaucuaccacacggagaacgcguacgugagcgucguguccucgcacuacaaccggcgcuucacccccgagaucgccaagcggccgaaggugcgcgaccaggagggccggaucaacuacuacuggacccugcucgagcccggcgacaccaucaucuucgaggccaacgggaaccugaucgcccccugguacgccuucgcgcugucccgcggcuucgggagcggcaucaucacguccaacgccagcauggacgagugcgacgccaagugccagacgccccagggcgccaucaacuccucgcucccguuccagaacguccaccccgugaccaucggggagugccccaaguacgugcgguccaccaagcugcgcauggucaccggccugcggaacauccccagcauccagucccgcggccucuucggcgccaucgcgggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgugaucgagaagaugaacacgcaguucaccgccgucggcaaggaguucaacaagcuggagcggcgcauggagaaccugaacaagaagguggacgacggguuccucgacaucuggaccuacaacgcggagcugcuggugcuccuggagaacgagcggacccuggacuuccacgacuccaacgucaagaaccucuacgagaaggucaagucgcagcugaagaacaacgccaaggagaucggcaacgggugcuucgaguucuaccacaagugcaacaacgagugcauggaguccgugaagaacggcacguacgacuacccgaaguacagcgaggagagcaagcugaaccgcgagaagaucgacggggugaagcucgaguccaugggcguguaccagauccuggccaucuacucgaccgucgccuccagccuggugcuccuggugucccugggcgccaucagcuucuggaugugcuccaacgggagccuccagugccggaucugcaucuga

SEQ ID NO: 1894 - RNA, 1701 nt, Artificial Sequence; identical to SEQ ID NO: 895
  derived and/or modified CDS sequence (AUadapt) from InfluenzaA__ABP49371__HA

SEQ ID NO: 1895 - RNA, 1701 nt, Artificial Sequence; identical to SEQ ID NO: 1632
  derived and/or modified CDS sequence (AUadapt) from InfluenzaA__ABP49382__HA

SEQ ID NO: 1896 - RNA, 1698 nt, Artificial Sequence
  derived and/or modified CDS sequence (AUadapt) from InfluenzaA__ABP49393__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccugugggggauccaccacccgcccaacaucggcgaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucggccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagucgaagcucaaccgcgagcggaucgacggcgugaagcuggaguccaugggcguguaccagauccuggccaucuacagcacggucgccagcucccucgugcugcuggugagccucggggccaucuccuucuggaugugcagcaacggcucccugcagugccgcaucugcaucuga

SEQ ID NO: 1897 - RNA, 1701 nt, Artificial Sequence
  derived and/or modified CDS sequence (AUadapt) from InfluenzaA__ABP49404__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucggcgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggaccggggugacccagaacggcacguccucggccugcaagcgccgguccaacaacucguucuucucccgccugaacuggcucacccaccugaaguucaaguaccccgcccugaacgugaccaugcccaacaacgagaaguucgacaagcucuacaucuggggcguccaccaccccgggaccuacaacgaccagaucagccuguacgcgcaggccuccggccggaucacggugucgaccaagcgcucgcagcagaccgugaucccgaacaucgggucccggccccgcguccgggacauccccagccgcaucuccaucuacuggaccaucgugaagcccggcgacauccugcucaucaacucgacggggaaccugaucgccccgcggggcuacuucaagauccgcuccggcaagagcuccaucaugcggucggacgcccccaucgggaagugcaacuccgagugcaucacccccaacggcucgauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggcuucaucgagaacgggugggagggcaugguggacgggugguacggcuuccgccaccagaacuccgaggggaucggccaggccgccgaccugaaguccacccaggcggccaucaaccagaucaacggcaagcugaaccggcucaucgggaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcacguacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 1898 - RNA, 1701 nt, Artificial Sequence; identical to SEQ ID NO: 895
  derived and/or modified CDS sequence (AUadapt) from InfluenzaA__ABP49415__HA

SEQ ID NO: 1899 - RNA, 1701 nt, Artificial Sequence; identical to SEQ ID NO: 895
  derived and/or modified CDS sequence (AUadapt) from InfluenzaA__ABP49426__HA

SEQ ID NO: 1900 - RNA, 1689 nt, Artificial Sequence
  derived and/or modified CDS sequence (AUadapt) from InfluenzaA__ABP49437__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccagcacccugaacaagcgcuccacccccgagaucgccacgcggcccaaggugaacggccucggcgggcgcauggaguucucguggacccugcuggacaugugggacaccaucaacuucgaguccaccggcaaccucaucgcccccgaguacggguucaagaucucgaagcggggcuccucggggaucaugaagacggagggcacccuggagaacugcgagaccaagugccagaccccgcugggcgccaucaacacgacccuccccuuccacaacgugcacccccugaccaucggggagugccccaaguacgucaagagcgagaagcuggugcucgcgaccggccugcgcaacgugccgcagaucgagucccgggggcuguucggcgccaucgccggguucaucgagggcggcuggcaggggauggucgacggcugguacggguaccaccacucgaacgaccagggcuccggguacgccgccgacaaggagucgacgcagaaggcguucgacggcaucaccaacaaggugaacuccgugaucgagaagaugaacacccaguucgaggccgucggcaaggaguucucgaaccucgagcgccggcuggagaaccugaacaagaagauggaggacggguuccucgacguguggaccuacaacgccgagcugcuggugcucauggagaacgagcgcacgcuggacuuccacgacuccaacgucaagaaccuguacgacaaggugcggaugcagcuccgcgacaacgucaaggagcugggcaacgggugcuucgaguucuaccacaagugcgacgacgagugcaugaacagcgugaagaacggcaccuacgacuaccccaaguacgaggaggaguccaagcugaaccggaacgagaucaagggcgugaagcucucguccaugggggucuaccagauccuggccaucuacgccaccguggcgggcucgcugucccucgccaucaugauggccgggaucucguucuggaugugcuccaacggcagccugcagugccgcaucugcaucuga

SEQ ID NO: 1901 - RNA, 1701 nt, Artificial Sequence
  derived and/or modified CDS sequence (AUadapt) from InfluenzaA__ABP49448__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucucgaagaaguccuggagcuacaucgccgagacccccaacuccgagaacgggaccugcuaccccggcuacuucgccgacuacgaggagcugcgggagcagcugagcuccgugucguccuucgagcgcuucgagaucuuccccaaggagcggagcuggccgaagcacaacgucacccgcggcgugacggccuccugcagccacaagggcaaguccagcuucuaccggaaccuccuguggcugaccgagaagaacggguccuaccccaaccucucgaagagcuacgugaacaacaaggagaaggagguccuggugcuguggggcgugcaccaccccuccaacaucgaggaccagaagaccaucuaccgcaaggagaacgccuacgucagcgugguguccucgaacuacaaccggcgcuucacccccgagaucuccgagcggccgaagguccgcgggcaggagggccggaucaacuacuacuggacgcuccuggagcccggcgacaccaucaucuucgaggcgaacgggaaccugaucgcccccugguacgccuucgcccucagccgcggcuucggguccggcaucaucaccagcaacgccuccauggacgagugcgacaccaagugccagacgccccagggcgcgaucaacucgucccugccguuccagaacgugcaccccgugaccaucggggagugccccaaguacguccggagcaccaagcugcgcauggugaccggccuccggaacauccccuccauccagagccgcgggcuguucggcgccaucgccggguucaucgagggcggcuggacggggaugaucgacggcugguacggguaccaccaccagaacgagcagggcuccggguacgccgccgaccagaaguccacccagaacgcgaucaacggcaucaccaacaaggugaacagcgucaucgagaagaugaacacccaguucacggccgugggcaaggaguucaacaagcuggagaagcggauggagaaccucaacaagaagguggacgacggguuccuggacaucuggaccuacaacgccgagcugcucguccugcuggagaacgagcgcacccucgacuuccacgacucgaacgugaagaaccuguacgagaaggucaagucccagcugaagaacaacgccaaggagaucggcaacgggugcuucgaguucuaccacaagugcaacaacgagugcauggagagcgugaagaacggcaccuacgacuacccgaaguacagcgaggaguccaagcucaaccgggagaagaucgacggggugaagcuggagucgaugggcgucuaccagauccuggccaucuacuccacgguggcgagcucccucgugcugcuggucagccucggcgccaucuccuucuggaugugcagcaacgggucccugcagugccgcaucugcaucuga

SEQ ID NO: 1902 - RNA, 1689 nt, Artificial Sequence
  derived and/or modified CDS sequence (AUadapt) from InfluenzaA__ABP49459__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccagcggcgagcagaugcucaucaucuggggcguccaccacccgaacgacgagaccgagcagcggacccuguaccagaacguggggacguacguguccgucgggacccccacccugaacaagcgcucgacccccgacaucgccacgcggcccaaggugaacggccagggcgggcgcauggaguucuccuggacccuccuggacaugugggacaccaucaacuucgagucgaccggcaaccugaucgccccggaguacggguucaagaucuccaagcggggcucguccgggaucaugaagacggagggcacccucggcaacugcgagaccaagugccagacgccccugggggccaucaacaccacccugcccuuccacaacgugcacccccucaccaucggcgagugcccgaaguacgucaagucggagaagcuggugcuggcgaccgggcuccgcaacgugccccagaucgagucgcggggccuguucggggccaucgccggcuucaucgagggcggguggcagggcauggucgacgggugguacggcuaccaccacuccaacgaccaggggagcggcuacgccgccgacaaggaguccacgcagaaggcguucgacggcaucaccaacaaggugaacucggugaucgagaagaugaacacccaguucgaggccgucgggaaggaguucuccaaccuggagcgccggcucgagaaccugaacaagaagauggaggacggcuuccuggacguguggaccuacaacgccgagcuccuggugcugauggagaacgagcgcacgcucgacuuccacgacucgaacgucaagaaccuguacgacaaggugcggaugcagcugcgcgacaacgucaaggagcucgggaacggcugcuucgaguucuaccacaagugcgacgacgagugcaugaacuccgugaagaacggcaccuacgacuaccccaaguacgaggaggagucgaagcugaaccggaacgagaucaagggggugaagcuguccucgaugggcgucuaccagauccucgccaucuacgccaccguggcggggucccugucgcuggccaucaugauggccggcaucuccuucuggaugugcagcaacgggucccuccagugccgcaucugcaucuga

SEQ ID NO: 1903 - RNA, 1689 nt, Artificial Sequence
  derived and/or modified CDS sequence (AUadapt) from InfluenzaA__ABP49470__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccagcggcgagcagaugcucaucaucuggggcguccaccacccgaacgacgagaccgagcagcggacccuguaccagaacguggggacguacguguccgucucgaccuccacccugaacaagcgcucgacccccgacaucgccacgcggcccaaggugaacgggcucggcggccgcauggaguucuccuggacccugcuggacaugugggacaccaucaacuucgagagcaccgggaaccucaucgcccccgaguacggcuucaagaucuccaagcgggggucgucgggcaucaugaagacggaggggacccugggcaacugcgagaccaagugccagaccccgcugggcgccaucaacacgacccuccccuuccacaacgugcacccccugaccaucggggagugccccaaguacgucaaguccgagaagcuggugcucgcgaccggccugcgcaacgugccgcagaucgagucgcgggggcuguucggcgccaucgccggguucaucgagggcggcuggcaggggauggucgacggcugguacggguaccaccacuccaacgaccagggcagcggguacgccgccgacaaggaguccacgcagaaggcguucgacggcaucaccaacaaggugaacucggugaucgagaagaugaacacccaguucgaggccgucggcaaggaguucuccaaccucgagcgccggcuggagaaccugaacaagaagauggaggacggguuccucgacguguggaccuacaacgccgagcugcuggugcucauggagaacgagcgcacgcuggacuuccacgacucgaacgucaagaaccuguacgacaaggugcggaugcagcuccgcgacaacgucaaggagcugggcaacgggugcuucgaguucuaccacaagugcgacgacgagugcaugaacuccgugaagaacggcaccuacgacuaccccaaguacgaggaggagagcaagcugaaccggaacgagaucaagggcgugaagcucuccucgaugggggucuaccagauccuggccaucuacgccaccguggcgggcucccugucgcucgccaucaugauggccgggaucuccuucuggaugugcagcaacggcucccugcagugccgcaucugcaucuga

SEQ ID NO: 1904 - RNA, 1701 nt, Artificial Sequence
  derived and/or modified CDS sequence (AUadapt) from InfluenzaA__ABP49492__HA
augaagaccaucaucgcccugucguacaucuucugccucguguucgcccagggccugcccgggaacgacaacuccaccgcgacgcugugccucggccaccacgccgucccgaacgggacccuggugaagaccaucaccaacgaccagaucgaggugacgaacgccaccgagcugguccagucguccagcaccggcaagaucugcgacaacccccaccgcauccucgacgggaucaacugcacccugaucgacgcccugcucggcgacccccacugcgacggcuuccagaacgagaagugggaccuguucguggagcgguccaaggccuucucgaacugcuaccccuacgacgugccggacuacgcgucccugcgcagccucgucgccuccucggggacgcuggaguucaucaacgagggcuucaacuggaccggggugacccagaacggcggguccagcuccugcaagcggggccccgacaacggcuucuucucgcgccugaacuggcucuacaaguccgggagcaccuaccccgugcagaacgucacgaugcccaacaacgacaacuccgacaagcuguacaucuggggcgugcaccacccgucgaccgacaaggagcagaccgaccuguacgugcaggccuccgggaaggucaccgugagcacgaagcggucgcagcagaccgugauccccaacgucggcucccgccccugggugcggggccucucgucccgcgugagcaucuacuggaccaucgucaagcccggggacauccuggugaucaacuccaacggcaaccugaucgccccgcggggguacuucaagaugcgcaccggcaagucguccaucaugcggagcgacgcgcccaucgggacgugcuccucggagugcaucacccccaacggcuccauccccaacgacaagccguuccagaacgugaacaagaucaccuacggcgccugccccaaguacgucaagcagaacacccucaagcuggccacggggaugcgcaacgugcccgagaagcagacccggggcaucuucggggccaucgccggcuucaucgagaacgggugggagggcaugaucgacggcugguacggguuccgccaccagaacagcgagggcaccgggcaggcggccgaccugaaguccacccaggccgccaucgaccagaucaacggcaagcucaaccgggugaucgagaagacgaacgagaaguuccaccagaucgagaaggaguucucggaggucgaggggcgcauccaggaccuggagaaguacguggaggacaccaagaucgaccugugguccuacaacgccgagcuccuggucgcgcuggagaaccagcacaccaucgaccucaccgacagcgagaugaacaagcuguucgagaagacgcggcgccagcugcgggagaacgccgaggacaugggcaacggcugcuucaagaucuaccacaagugcgacaacgccugcaucggguccauccgcaacggcaccuacgaccacgacguguaccgggacgaggcccucaacaaccgcuuccagaucaaggggguggagcucaagucgggcuacaaggacuggauccuguggaucuccuucgccaucagcugcuuccugcugugcgucgugcugcucggcuucaucaugugggcgugccagaaggggaacauccgcugcaacaucugcaucuga

SEQ ID NO: 1905 - RNA, 1701 nt, Artificial Sequence; identical to SEQ ID NO: 1801
  derived and/or modified CDS sequence (AUadapt) from InfluenzaA__ABP49503__HA

SEQ ID NO: 1906 - RNA, 1701 nt, Artificial Sequence
  derived and/or modified CDS sequence (AUadapt) from InfluenzaA__ABP49514__HA
augaagaccaucaucgcccugucguacaucuucuaccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 1907 - RNA, 1701 nt, Artificial Sequence
  derived and/or modified CDS sequence (AUadapt) from InfluenzaA__ABQ01311__HA
augaaggcccgccugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccggcugaagggcaucgcgccccuccagcuggggaagugcaacaucgccggcuggauccuggggaacccggagugcgagagccuccuguccaaccgcucgugguccuacaucgccgagacccccaacagcgagaacgggaccugcuaccccggcgacuucgccgacuacgaggagcugcgggagcagcucuccucgguguccagcuucgagcgcuucgagaucuuccccaaggagcgguccuggccgaagcacaacaucacccgcggggugacggccgccugcucgcacgcgaagaaguccagcuucuacaagaaccugcuguggcucaccgaggccaacggcuccuaccccaaccugucgaaguccuacgucaacaacaaggagaaggaggugcuggugcucuggggcguccaccaccccagcaagaucgaggaccagcggacccuguaccgcaaggagaacgccuacgugucgguggucuccagcaacuacaaccggcgcuucacccccgagaucgccgagcggccgaaggugcgcggccaggccgggcggaugaacuacuacuggacgcugcucgagcccggcgacaagaucaucuucgaggcgaacggcaaccugaucgcccccugguacgccuucgcccugucccgcgggcucggcucggggaucaucaccuccaacgccagcauggacgagugcgacaccaagugccagacgccccagggcgcgaucaacuccucgcugccguuccagaacauccaccccgugaccaucggcgagugccccaaguacguccgguccaccaagcugcgcauggugaccgggcuccggaacauccccagcauccagucccgcggccuguucggggccaucgccggcuucaucgagggcggguggaccggcaugguggacgggugguacggcuaccaccaccagaacgagcaggggucgggcuacgccgccgaccagaaguccacgcagaacgcgaucaacgggaucaccaacaaggucaacagcgugaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacuccaacgugaagaaccuguacgagaaggucaagaaccagcugcggaacaacgccaaggagaucgggaacggcugcuucgaguucuaccacaagugcgacaacgagugcauggagucggugaagaacgggaccuacgacuacccgaaguacuccgaggagagcaagcucaaccgcgagaagaucgacggcgucaagcuggaguccauggggguguaccagauccuggccaucuacucgaccguggcgagcucccucguccugcuggugucgcucggcgccaucuccuucuggaugugcagcaacggcucccugcagugccgcaucugcaucuga

SEQ ID NO: 1908 - RNA, 1701 nt, Artificial Sequence
  derived and/or modified CDS sequence (AUadapt) from InfluenzaA__ABQ01322__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccaccuggggaagugcucgaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugucguccgugagcuccuucgagcgcuucgagaucuuccccaaggagcggagcuggccgaagcacaacgucacccgcggcgugacggccgccugcucccacaagggcaagucguccuucuaccggaaccuccuguggcugaccgagaagaacgggagcuaccccaaccucuccaagagcuacgugaacaacaaggagaaggagguccuggugcuguggggcgugcaccaccccucgaacaucgaggaccagaagaccaucuaccgcaaggagaacgcguacgucuccguggugagcuccaacuacaaccggcgcuucacccccgagaucgccaagcggccgaagguccgcgggcaggagggccggaucaacuacuacuggacgcuccuggagcccggcgacaccaucaucuucgaggccaacgggaaccugaucgcccccugguacgccuucgcgcucagccgcggcuucggguccggcaucaucaccucgaacgccuccauggacgagugcgacgccaagugccagacgccccagggcgccaucaacagcucccugccguuccagaacgugcaccccgugaccaucggggagugccccaaguacguccggagcaccaagcugcgcauggugaccggccuccggaacauccccuccauccagucgcgcgggcuguucggcgccaucgcgggguucaucgagggcggcuggaccgggaugaucgacggcugguacggguaccaccaccagaacgagcagggcuccggguacgccgccgaccagaaguccacgcagaacgccaucaacggcaucaccaacaaggugaacagcgucaucgagaagaugaacacccaguucaccgccgugggcaaggaguucaacaagcuggagaagcggauggagaaccucaacaagaagguggacgacggguuccuggacaucuggacguacaacgcggagcugcucguccugcuggagaacgagcgcacccucgacuuccacgacagcaacgugaagaaccuguacgagaaggucaagucccagcugaagaacaacgccaaggagaucggcaacgggugcuucgaguucuaccacaagugcaacaacgagugcauggagucggugaagaacggcaccuacgacuacccgaaguacuccgaggagagcaagcucaaccgggagaagaucgacggggugaagcuggagagcaugggcgucuaccagauccuggccaucuacuccaccguggccucgucccucgugcugcuggucagccucggcgccaucuccuucuggaugugcagcaacgggucccugcagugccgcaucugcaucuga

SEQ ID NO: 1909 - RNA, 1701 nt, Artificial Sequence; identical to SEQ ID NO: 895
  derived and/or modified CDS sequence (AUadapt) from InfluenzaA__ABQ01333__HA

SEQ ID NO: 1910 - RNA, 1701 nt, Artificial Sequence
  derived and/or modified CDS sequence (AUadapt) from InfluenzaA__ABQ01344__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagccggaucuccaucuacuggacgaucgucaagcccggggacauccuccugaucaacugcaccggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucggcaagaccaacgagaaguuccaccagaucgagaaggaguucuccgagguggaggggcggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgcggaggacaugggcaacgggugcuucaagaucuaccacaagugcgacaacgccugcaucggcagcauccgcaacgggaccuacgaccacgacguguaccgcgacgaggcccugaacaaccgguuccagaucaagggcgucgagcugaaguccggcuacaaggacuggauccucuggaucucguucgccaucagcugcuuccugcugugcgugguccuccugggguucaucaugugggccugccagaagggcaacauccgcugcaacaucugcaucuga

SEQ ID NO: 1911 - RNA, 1689 nt, Artificial Sequence
  derived and/or modified CDS sequence (AUadapt) from InfluenzaA__ABQ01355__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcgacggccucugcuacccgggguccuucaacgacuacgaggagcugaagcaccuccugucguccgugaagcacuucgagaaggugcggauccugcccaaggaccgcuggacgcagcacaccaccaccggcgggagccgggccugcgccgucuccggcaaccccucguucuuccgcaacaugaucuggcugacgaagaagggguccaacuaccccguggcgaagggcucguacaacaacaccuccggcgagcagaugcucaucaucuggggcgugcaccacccgaucgacgagaccgagcagcggacccuguaccagaacgucgagacguacgugagcguggucaccuccacccugaacaagcgcucgacccccaagaucgccacgcggcccaaggugaacgggcucgggggccgcauggaguucuccuggacccugcuggacaugugggacaccaucaacuucgagucgaccggcaaccucaucgcccccgaguacggguucaagaucuccaagcggggcagcuccgggaucaugaagacggagggcacccuggagaacugcgagaccaagugccagaccccgcugggggccaucaacacgacccuccccuuccacaacgugcacccccugaccaucggcgagugccccaaguacgucaagucggagaagcuggugcucgcgaccggccugcgcaacgugccgcagaucgagucgcgggggcuguucggcgccaucgccggguucaucgagggcggguggcagggcauggucgacggcugguacggguaccaccacuccaacgaccagggcagcggguacgccgccgacaaggaguccacgcagcgcgcguucgacggcaucaccaacaaggugaacucggugaucgagaagaugaacacccaguucgaggccgucgggaaggaguucuccaaccucgagcggcgccuggagaaccugaacaagaagauggaggacggcuuccucgacguguggaccuacaacgccgagcugcuggugcucauggagaacgagcggacgcuggacuuccacgacucgaacgucaagaaccuguacgacaaggugcgcaugcagcuccgggacaacgucaaggagcugggcaacgggugcuucgaguucuaccacaagugcgacgacgagugcaugaacuccgugaagaacggcaccuacgacuaccccaaguacgaggaggagagcaagcugaaccgcaacgagaucaagggggugaagcucuccucgaugggcgucuaccagauccuggccaucuacgccaccguggcgggcucccugucgcucgccaucaugauggccgggaucuccuucuggaugugcagcaacggcucccugcagugccgcaucugcaucuga

SEQ ID NO: 1912 - RNA, 1701 nt, Artificial Sequence
  derived and/or modified CDS sequence (AUadapt) from InfluenzaA__ABQ01366__HA
augaagaccaucaucgcccugucguacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgugccggacuacgcgucccugcgcagccucgucgccuccucgggcacgcuggaguucaucaacgagggguucaacuggaccggcgugacccagaacgggggcuccagcgccugcaagcgggggcccgacaacggcuucuucucccgccugaacuggcucuacaagucgggcuccaccuaccccgugcagaacgucacgaugaccaacaacgacaacucggacaagcuguacaucuggggcgugcaccaccccuccaccgacaaggagcagaccgaccuguacgugcaggccagcggcaaggucacgguguccaccaagcggucgcagcagaccaucaucccgaacguggggagccgccccuggguccggggccucuccucgcgcguguccaucuacuggaccaucgugaagcccggcgacauccuggucaucaacagcaacgggaaccugaucgcgccccggggcuacuucaagaugcgcacggggaaguccucgaucaugcgguccgacgccccgaucgggaccugcucguccgagugcaucacccccaacgggagcauccccaacgacaagcccuuccagaacgugaacaagaucaccuacggcgccugcccgaaguacgugaagcagaacacgcucaagcuggccaccggcaugcgcaacguccccgagaagcagacccgggggaucuucggcgccaucgcgggguucaucgagaacggcugggaggggaugaucgacggcugguacggcuuccgccaccagaacuccgaggggaccggccaggccgccgaccucaagucgacgcaggccgccaucgaccagaucaacgggaagcugaaccgggugaucgagaagaccaacgagaaguuccaccagaucgagaaggaguucuccgagguggagggccgcauccaggaccuggagaaguacgucgaggacaccaagaucgaccuguggagcuacaacgcggagcuccugguggcccuggagaaccagcacaccaucgaccucacggacuccgagaugaacaagcuguucgagaagacccggcgccagcugcgggagaacgccgaggacauggggaacggcugcuucaagaucuaccacaagugcgacaacgccugcaucggcucgauccgcaacgggaccuacgaccacgacgucuaccgggacgaggcccucaacaaccgcuuccagaucaagggcguggagcugaaguccggguacaaggacuggauccuguggaucagcuucgcgaucuccugcuuccuccugugcgugguccugcucggcuucaucaugugggccugccagaagggcaacauccgcugcaacaucugcaucuga

SEQ ID NO: 1913 - RNA, 1701 nt, Artificial Sequence; identical to SEQ ID NO: 1678
  derived and/or modified CDS sequence (AUadapt) from InfluenzaA__ABQ44383__HA

SEQ ID NO: 1914 - RNA, 1701 nt, Artificial Sequence; identical to SEQ ID NO: 878
  derived and/or modified CDS sequence (AUadapt) from InfluenzaA__ABQ44405__HA

SEQ ID NO: 1915 - RNA, 1701 nt, Artificial Sequence
  derived and/or modified CDS sequence (AUadapt) from InfluenzaA__ABQ44416__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcguguccucguucgagcgcuucgagaucuuccccaaggaguccagcuggccgaaccacacggucaccaagggggugaccgccuccugcagccacaagggcaaguccagcuucuaccggaaccugcucuggcugaccgagaagaacggguccuaccccaaccugucgaagagcuacgugaacaacaaggagaaggagguccucgugcuguggggcgugcaccaccccuccaacaucggggaccagcgcgccaucuaccacacggagaacgcguacgucagcgugguguccucgcacuacaaccggcgcuucacccccgagaucgccaagcggccgaagguccgcgaccaggagggccggaucaacuacuacuggacccugcucgagcccgaggacaccaucaucuucgaggccaacggcaaccugaucgcccccugguacgccuucgcgcugucccgcggguucggcagcgggaucaucacguccaacgccagcauggacgagugcgacgccaagugccagacgccccagggcgccaucaacuccucgcucccguuccagaacgugcaccccgugaccaucggcgagugccccaaguacguccgguccaccaagcugcgcauggugaccgggcugcggaacauccccagcauccagucccgcggccucuucggggccaucgcgggcuucaucgagggcggcuggaccggcaugaucgacgggugguacggcuaccaccaccagaacgagcaggggagcggcuacgccgccgaccagaaguccacccagaacgccaucaacgggaucaccaacaaggugaacagcgucaucgagaagaugaacacgcaguucaccgccgugggcaaggaguucaacaagcuggagcggcgcauggagaaccugaacaagaagguggacgacggcuuccucgacaucuggaccuacaacgcggagcugcugguccuccuggagaacgagcggacccuggacuuccacgacuccaacgugaagaaccucuacgagaaggucaagucgcagcugaagaacaacgccaaggagaucgggaacggcugcuucgaguucuaccacaagugcaacaacgagugcauggaguccgugaagaacgggacguacgacuacccgaaguacagcgaggagagcaagcugaaccgcgagaagaucgacggcgugaagcucgaguccaugggggucuaccagauccuggccaucuacucgaccguggccuccagccuggugcuccuggucucccugggcgccaucagcuucuggaugugcuccaacggcagccuccagugccggaucugcaucuga

SEQ ID NO: 1916 - RNA, 1701 nt, Artificial Sequence; identical to SEQ ID NO: 501
  derived and/or modified CDS sequence (AUadapt) from InfluenzaA__ABQ44427__HA

SEQ ID NO: 1917 - RNA, 1689 nt, Artificial Sequence
  derived and/or modified CDS sequence (AUadapt) from InfluenzaA__ABQ44438__HA
auggccaucaucuacuucauccugcuguucaccgccgugcgcggcgaccagaucugcaucggguaccacgcgaacaacucgaccgagaaggucgacacgauccuggagcggaacgugaccgugacccacgccaaggacauccuggagaagacccacaacggcaagcucugcaagcugaacgggaucccgccccuggagcucggcgacugcuccaucacgggguggcugcugggcaaccccgagugcgaccgccuccugcggguccccgaguggucguacaucauggagaaggagaacccccgcuacucccugugcuacccgggcagcuucaacgacuacgaggagcucaagcaccuccuguccucggugaagcacuucgagaaggugcggauccuccccaaggacggguggacccagcacaccaccuccggcgggagcaaggccugcgccgucuccggcaagucguccuucuuccgcaacaugguguggcugacgaagaaggggcccaacuaccccguggccaagcggagcuacaacaacaccuccggcgagcagaugcugaucaucuggggcguccaccacccgaacgacgaggcggagcagucggcccucuaccagaagguggggaccuacguguccgccucgaccuccacgcugaacaagcgcagcacccccgagaucgccgcgcggcccgaggucaacggccuggggucccgcauggaguucucguggacccuccuggacgugugggacaccaucaacuucgagagcacgggcaaccugguggcccccgaguacggcuucaagaucuccaagcgggggucguccggcaucaugaagaccgaggggacccucggcaacugcgagaccaagugccagacgccgcugggggccaucaacaccacccugcccuuccacaacguccacccccucaccaucggcgagugccccaaguacgucaagagcgagaagcuggugcuggccacgggccuccgcaacgugccgcagaucgagucccgggggcuguucggcgccaucgcgggguucaucgagggcggguggcagggcaugguggacggcugguacggguaccaccacucgaacgaccagggcuccggguacgccgccgacaaggagucgacccagaaggccuucgaccgcaucaccaacaaggugaacuccgucaucgagaagaugaacacccaguucgaggccgugggcaaggaguucagcaaccuggagaagcggcucgagaaccugaacaagaagauggaggacggguuccuggacguguggacguacaacgcggagcuccugguccugauggagaacgagcgcacccucgacuuccacgacuccaacgugaagaaccuguacaacaagguccggaugcagcugcgcgacaacgugaaggagcucggcaacggcugcuucgaguucuaccacaagugcgacgacgagugcaugucguccgugaagaacgggaccuacgacuaccccaaguacgaggaggagagcaagcugaagcggaacgagaucaagggcgucaagcuguccucgauggggguguaccagauccucgccaucuacgccaccguggccggcucccugagccuggccaucaugaucgcgggcaucucccucuggaugugcucgaacgggagccugcagugccgcaucugcaucuga

SEQ ID NO: 1918 - RNA, 1689 nt, Artificial Sequence
  derived and/or modified CDS sequence (AUadapt) from InfluenzaA__ABQ44460__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugaucuggcugacgaagaaggggucgaacuaccccguggcgaagggcuccuacaacaacaccagcggcgagcagaugcucaucaucuggggcgugcaccacccgaacgacgagaccgagcagcggacccuguaccagaacgucgggacguacguguccguggggaccucgacccugaacaagcgcuccacccccgacaucgccacgcggcccaaggucaacggccucggcucgcgcauggaguucuccuggacccugcuggacaugugggacaccaucaacuucgagagcaccgggaaccucaucgcccccgaguacggcuucaagaucuccaagcgggggucgucgggcaucaugaagacggaggggacccugggcaacugcgagaccaagugccagaccccgcugggcgccaucaacacgacccuccccuuccacaacgugcacccccugaccaucggggagugccccaaguacgugaaguccgagaagcugguccucgcgaccggccugcgcaacgugccgcagaucgagucgcgggggcuguucggcgccaucgccggguucaucgagggcggcuggcaggggaugguggacggcugguacggguaccaccacuccaacgaccagggcagcggguacgccgccgacaaggaguccacgcagaaggcguucgacggcaucaccaacaaggucaacucggugaucgagaagaugaacacccaguucgaggccgugggcaaggaguucuccaaccucgagcgccggcuggagaaccugaacaagaagauggaggacggguuccucgacgucuggaccuacaacgccgagcugcuggugcucauggagaacgagcgcacgcuggacuuccacgacucgaacgugaagaaccuguacgacaagguccggaugcagcuccgcgacaacgugaaggagcugggcaacgggugcuucgaguucuaccacaagugcgacgacgagugcaugaacuccgucaagaacggcaccuacgacuaccccaaguacgaggaggagagcaagcugaaccggaacgagaucaagggcgugaagcucuccucgauggggguguaccagauccuggccaucuacgccaccgucgcgggcucccugucgcucgccaucaugauggccgggaucuccuucuggaugugcagcaacggcucccugcagugccgcaucugcaucuga

SEQ ID NO: 1919 - RNA, 1701 nt, Artificial Sequence
  derived and/or modified CDS sequence (AUadapt) from InfluenzaA__ABQ44471__HA
augaaggcccgccugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccggcugaagggcaucgcgccccuccagcuggggaagugcaacaucgccggcuggauccuggggaacccggagugcgagagccuccuguccaaccgcucgugguccuacaucgccgagacccccaacagcgagaacgggaccugcuaccccggcgacuucgccgacuacgaggagcugcgggagcagcucuccucgguguccagcuucgagcgcuucgagaucuuccccaaggagcgguccuggccgaagcacaacaucacccgcggggugacggccgccugcucgcacgcgaagaaguccucguucuacaagaaccugcuguggcucaccgaggccaacggcuccuaccccaaccugagcaaguccuacgucaacaacaaggagaaggaggugcuggugcucuggggcguccaccaccccucgaacaucgaggaccagcggacccuguaccgcaaggagaacgccuacgugagcguggucuccucgaacuacaaccggcgcuucacccccgagaucgccgagcggccgaaggugcgcggccaggccgggcggaugaacuacuacuggacgcugcucgagcccggcgacaagaucaucuucgaggcgaacggcaaccugaucgcccccugguacgccuucgcccugucccgcgggcucggcagcgggaucaucaccuccaacgccucgauggacgagugcgacaccaagugccagacgccccagggcgcgaucaacaacucccugccguuccagaacauccaccccgugaccaucggcgagugccccaaguacguccggagcaccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgccgccgaccagaaguccacgcagaacgcgaucaacgggaucaccaacaaggucaacucggugaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacagcaacgugaagaaccuguacgagaaggucaagaaccagcugcggaacaacgccaaggagaucgggaacggcugcuucgaguucuaccacaagugcgacaacgagugcauggaguccgugaagaacgggaccuacgacuacccgaaguacucggaggaguccaagcucaaccgcgagaagaucgacggcgucaagcuggagagcauggggguguaccagauccuggccaucuacuccaccguggcgucgagccucguccugcuggugucccucggcgccaucucguucuggaugugcuccaacggcagccugcagugccgcaucugcaucuga

SEQ ID NO: 1920 - RNA, 1701 nt, Artificial Sequence
  derived and/or modified CDS sequence (AUadapt) from InfluenzaA__ABR15797__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 1921 - RNA, 1701 nt, Artificial Sequence
  derived and/or modified CDS sequence (AUadapt) from InfluenzaA__ABR15808__HA
augaaggcccgccugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccggcugaagggcaucgcgccccuccagcuggggaagugcaacaucgccggcuggauccuggggaacccggagugcgagagccuccuguccaaccgcucgugguccuacaucgccgagacccccaacagcgagaacgggaccugcuaccccggcgacuucgccgacuacgaggagcugcgggagcagcucuccucgguguccagcuucgagcgcuucgagaucuuccccaaggagcgguccuggccgaagcacaacaucacccgcggggugacggccgccugcucgcacgcgaagaaguccagcuucuacaagaaccugcuguggcucaccgaggccaacggcuccuaccccaaccugucgaaguccuacgucaacaacaaggagaaggaggugcuggugcucuggggcguccaccaccccagcaacaucgaggaccagcggacccuguaccgcaaggagaacgccuacgugucgguggucuccagcaacuacaaccggcgcuucacccccgagaucgccgagcggccgaaggugcgcggccaggccgggcggaugaacuacuacuggacgcugcucgagcccggcgacaagaucaucuucgaggcgaacggcaaccugaucgcccccugguacgccuucgcccugucccgcgggcucggcucggggaucaucaccuccaacgccagcauggacgagugcgacaccaagugccagacgccccagggcgcgaucaacuccucgcugccguuccagaacauccaccccgugaccaucggcgagugccccaaguacguccgguccaccaagcugcgcauggugaccgggcuccggaacauccccagcauccagucccgcggccuguucggggccaucgccggcuucaucgagggcggguggaccggcaugguggacgggugguacggcuaccaccaccagaacgagcaggggucgggcuacgccgccgaccagaaguccacgcagaacgcgaucaacgggaucaccaacaaggucaacagcgugaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacuccaacgugaagaaccuguacgagaaggucaagaaccagcugcggaacaacgccaaggagaucgggaacggcugcuucgaguucuaccacaagugcgacaacgagugcauggagucggugaagaacgggaccuacgacuacccgaaguacuccgaggagagcaagcucaaccgcgagaagaucgacggcgucaagcuggaguccauggggguguaccagauccuggccaucuacucgaccguggcgagcucccucguccugcuggugucgcucggcgccaucuccuucuggaugugcagcaacggcucccugcagugccgcaucugcaucuga

SEQ ID NO: 1922 - RNA, 1698 nt, Artificial Sequence; identical to SEQ ID NO: 987
  derived and/or modified CDS sequence (AUadapt) from InfluenzaA__ABR15885__HA

SEQ ID NO: 1923 - RNA, 1698 nt, Artificial Sequence
  derived and/or modified CDS sequence (AUadapt) from InfluenzaA__ABR15896__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgaggcccccaaccccgagaacgggaccugcuaccccggcuacuucgccgacuacgaggagcugcgcgagcagcucuccagcguguccagcuucgagcgguucgagaucuucccgaaggaguccucguggcccaaccacacggugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucggcgaccagcgggcccuguaccacaccgagaacgccuacgugagcgucgugagcucccacuacucgcgccgguucacgcccgagaucgcgaagcgccccaaggugcgggaccaggagggccgcaucaacuacuacuggacccuccuggagcccggggacaccaucaucuucgaggccaacggcaaccugaucgccccgugguacgccuucgcccucucccggggguucggcagcggcaucaucaccuccaacgcgcccauggacgagugcgacgccaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgcgggcuucaucgagggcggguggaccggcaugguggacgggugguacggcuaccaccaccagaacgagcagggguccggcuacgccgccgaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuuccuggacaucuggacguacaacgcggagcugcucgugcugcuggagaacgagcgcacccucgacuuccacgacucgaacgugaagaaccuguacgagaaggucaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcaccguggccagcucccucgugcugcuggucagccucggggccaucuccuucuggaugugcagcaacggcucccugcagugccgcaucugcaucuga

SEQ ID NO: 1924 - RNA, 1698 nt, Artificial Sequence; identical to SEQ ID NO: 986
  derived and/or modified CDS sequence (AUadapt) from InfluenzaA__ABR15907__HA

SEQ ID NO: 1925 - RNA, 1698 nt, Artificial Sequence; identical to SEQ ID NO: 987
  derived and/or modified CDS sequence (AUadapt) from InfluenzaA__ABR15918__HA

SEQ ID NO: 1926 - RNA, 1701 nt, Artificial Sequence
  derived and/or modified CDS sequence (AUadapt) from InfluenzaA__ABR15929__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcaucuccagccgcaucuccaucuacuggacgaucgucaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacguggaggacaccaagaucgaccucuggucguacaacgccgagcugcuggucgcccucgagaaccagcacaccaucgaccugacggacuccgagaugaacaagcuguucgagcggaccaagaagcagcuccgcgagaacgccgaggacauggggaacggcugcuucaagaucuaccacaagugcaacaacgccugcaucgggagcauccgcaacggcaccuacgaccacgacguguaccgggacgaggcgcugaacaaccgcuuccagaucaaggggguggagcugaaguccggcuacaaggacuggauccucuggaucucguucgccaucagcugcuuccugcugugcaucguccuccugggcuucaucaugugggccugccagaaggggaacauccggugcaacaucugcaucuga

SEQ ID NO: 1927 - RNA, 1701 nt, Artificial Sequence
  derived and/or modified CDS sequence (AUadapt) from InfluenzaA__ABR15940__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacagcaccggcaaccugaucgcgccccggggguacuucaagauccgcuccggcaagucguccaucaugcggagcgacgccccgaucggcaagugcaacuccgagugcaucacccccaacgggucgaucuccaacgacaagcccuuccagaacgugaaccgcaucaccuacggcgccugcccccgguacgucaagcagaacacgcucaagcuggccaccgggaugcgcaacgugccggagaagcagacccggggcaucuucggggccaucgccggcuucaucgagaacggcugggaggggaugauggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucucggagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcugaaguccggcuacaaggacugggugcucuggaucagcuucgccaucuccugcuuccugcugugcaucguccuccugggcuucaucaugugggccugccagaaggggaacauccggugcaacaucugcaucuga

SEQ ID NO: 1928 - RNA, 1701 nt, Artificial Sequence; identical to SEQ ID NO: 807
  derived and/or modified CDS sequence (AUadapt) from InfluenzaA__ABR15951__HA

SEQ ID NO: 1929 - RNA, 1701 nt, Artificial Sequence
  derived and/or modified CDS sequence (AUadapt) from InfluenzaA__ABR15962__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgcgcgccuacuccaacugcuaccccuacgacgugccggacuacgucagccuccggucccugguggcgucguccggcacgcuggaguucaacaacgagagcuucaacuggaccgggguggcccagaacggcaccuccucggccugcaagcgccgguccgacaagagcuucuucucccgccucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgggugaccgucucgaccaagcgcucccagcagaccgugaucccgaacaucggcagccggcccugggugcgcggcgucuccucgaucaucuccaucuacuggacgaucgugaagcccggggacauccuccugaucaacagcaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggucgauccgcaacggcaccuacgaccacgacguguaccgggacgaggcgcugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 1930 - RNA, 1701 nt, Artificial Sequence
  derived and/or modified CDS sequence (AUadapt) from InfluenzaA__ABR22241__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccucgcuccgcucccugguggccagcuccggcacgcuggaguucaacaacgagucguucaacuggaccggggucgcccagaacggcaccuccagcgcgugcaagcggcgcuccaucaagucguucuucucccggcucaacuggcugcaccagcuggaguaccgcuaccccgcccucaacgugaccaugcccaacaacgacaaguucgacaagcuguacaucuggggcgugcaccaccccagcacggacuccgaccagaucucggucuacgcccaggccagcgggcgggugaccguguccaccaagcgcucgcagcagaccgucaucccgaacaucgggucccggcccugggugcgcggcaucagcucccggaucucgaucuacuggacgaucgugaagcccggcgacauccugcucaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacucggaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagaacaccaucgaccucacggacucggagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 1931 - RNA, 1701 nt, Artificial Sequence; identical to SEQ ID NO: 895
  derived and/or modified CDS sequence (AUadapt) from InfluenzaA__ABR28515__HA

SEQ ID NO: 1932 - RNA, 1701 nt, Artificial Sequence
  derived and/or modified CDS sequence (AUadapt) from InfluenzaA__ABR28592__HA
augaagaccaucaucgcccugucguacguguucugccucgucuucgcccaggaccugcccggcaacgacaacuccaccgcgacgcugugccucgggcaccacgccgugccgaacggcacccuggugaagaccaucaccaacgaccagaucgaggucacgaacgccaccgagcuggugcagucguccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucucgaacugcuaccccuacgacgucccggacuacgcgucccugcgcagccucguggccuccucgggcacgcuggaguucaucaacgagggguucaacuggaccggcgugacccagaacgggggcuccagcgccugcaagcgggggcccgacaacggcuucuucucccgccugaacuggcucuacaagucgggcuccaccuaccccguccagaacgugacgaugcccaacaacgacaacucggacaagcuguacaucuggggcgugcaccacccguccaccgacaaggagcagaccgaccuguacguccaggccagcgggaaggugaccguguccacgaagcggucgcagcagaccgucauccccaacguggggagccgccccugggugcggggccucuccucgcgcgucuccaucuacuggaccaucgugaagcccggcgacauccuggugaucaacagcaacgggaaccugaucgcgccgcggggcuacuucaagaugcgcaccgggaaguccucgaucaugcgguccgacgcccccaucggcacgugcucguccgagugcaucacccccaacgggagcauccccaacgacaagccguuccagaacgucaacaagaucaccuacggcgccugccccaaguacgugaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggucaucgagaagacgaacgagaaguuccaccagaucgagaaggaguucuccgagguggagggccgcauccaggaccuggagaaguacgucgaggacaccaagaucgaccuguggagcuacaacgcggagcuccugguggcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcucgauccgcaacgggaccuacgaccacgacguguaccgggacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagaagggcaacauccgcugcaacaucugcaucuga

SEQ ID NO: 1933 - RNA, 1698 nt, Artificial Sequence; identical to SEQ ID NO: 987
  derived and/or modified CDS sequence (AUadapt) from InfluenzaA__ABR28768__HA

SEQ ID NO: 1934 - RNA, 1698 nt, Artificial Sequence; identical to SEQ ID NO: 987
  derived and/or modified CDS sequence (AUadapt) from InfluenzaA__ABR28779__HA

SEQ ID NO: 1935 - RNA, 1701 nt, Artificial Sequence; identical to SEQ ID NO: 1678
  derived and/or modified CDS sequence (AUadapt) from InfluenzaA__ABR28790__HA

SEQ ID NO: 1936 - RNA, 1698 nt, Artificial Sequence; identical to SEQ ID NO: 987
  derived and/or modified CDS sequence (AUadapt) from InfluenzaA__ABR28801__HA

SEQ ID NO: 1937 - RNA, 1701 nt, Artificial Sequence; identical to SEQ ID NO: 895
  derived and/or modified CDS sequence (AUadapt) from InfluenzaA__ABR28812__HA

SEQ ID NO: 1938 - RNA, 1701 nt, Artificial Sequence
  derived and/or modified CDS sequence (AUadapt) from InfluenzaA__ABR28823__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcaucuccagccgcaucuccaucuacuggacgaucgucaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcccgugcccccgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacguggaggacaccaagaucgaccucuggucguacaacgccgagcugcuggucgcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaaggggguggagcugaaguccggcuacaaggacuggauccucuggaucucguucgccaucagcugcuuccugcugugcaucguccuccugggcuucaucaugugggccugccagaaggggaacauccggugcaacaucugcaucuga

SEQ ID NO: 1939 - RNA, 1698 nt, Artificial Sequence; identical to SEQ ID NO: 1115
  derived and/or modified CDS sequence (AUadapt) from InfluenzaA__ABR28834__HA

SEQ ID NO: 1940 - RNA, 1698 nt, Artificial Sequence; identical to SEQ ID NO: 1086
  derived and/or modified CDS sequence (AUadapt) from InfluenzaA__ABR28845__HA

SEQ ID NO: 1941 - RNA, 1701 nt, Artificial Sequence
  derived and/or modified CDS sequence (AUadapt) from InfluenzaA__ABR28856__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaucaugcccaacaacgagaaguucgacaagcuguacaucuggggcgugcaccaccccgggaccgacucggaccagaucucccuguacgcgcaggccagcgggcgcgugacggucucgaccaagcggucccagcagaccgugaucccgaacaucggcagccgccccugggugcggggcgucuccucgcgcaucuccaucuacuggaccaucgugaagcccggggacauccuccugaucaacagcacgggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcgccugcccgcgguacgucaagcagaagacccucaagcuggccacggggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacccaggcggccaucaaccagaucaacggcaagcucaaccggcugaucgagaagacgaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagcggacgaagaagcagcuccgcgagaacgccgaggacauggggaacggcugcuucaagaucuaccacaagugcgacaacgcgugcaucgggucgauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 1942 - RNA, 1701 nt, Artificial Sequence; identical to SEQ ID NO: 852
  derived and/or modified CDS sequence (AUadapt) from InfluenzaA__ABR28867__HA

SEQ ID NO: 1943 - RNA, 1701 nt, Artificial Sequence; identical to SEQ ID NO: 807
  derived and/or modified CDS sequence (AUadapt) from InfluenzaA__ABR28878__HA

SEQ ID NO: 1944 - RNA, 1698 nt, Artificial Sequence; identical to SEQ ID NO: 1449
  derived and/or modified CDS sequence (AUadapt) from InfluenzaA__ABR28900__HA

SEQ ID NO: 1945 - RNA, 1701 nt, Artificial Sequence
  derived and/or modified CDS sequence (AUadapt) from InfluenzaA__ABR28922__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcguguccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 1946 - RNA, 1701 nt, Artificial Sequence; identical to SEQ ID NO: 1826
  derived and/or modified CDS sequence (AUadapt) from InfluenzaA__ABR88080__HA

SEQ ID NO: 1947 - RNA, 1701 nt, Artificial Sequence
  derived and/or modified CDS sequence (AUadapt) from InfluenzaA__ABS00315__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcgucuccagcuucgagcgcuucgagaucuuccccaaggaguccucguggccgaaccacacggugaccaagggcguguccgccagcugcucccacaagggccggagcuccuucuaccgcaaccugcucuggcugaccgagaagaacgggagcuaccccaaccugucgaaguccuacgucaacaacaaggagcgggaggugcucgugcuguggggcguccaccaccccagcaacaucggggagcagcgcgccaucuaccacaccgagaacgcguacguguccguggucagcucccacuacaaccggcgcuucacgcccgagaucgccaagcggccgaaggugcgcggccaggagggccggaucaacuacuacuggacccugcucgagcccggggacaccaucaucuucgaggccaacggcaaccugaucgcccccugguacgccuucgcgcugagccgcggguucggcuccggcaucaucaccucgaacgccuccauggacgagugcgacgccaagugccagacgccccagggggccaucaacagcucccucccguuccagaacgugcaccccgucaccaucggcgagugccccaaguacgugcggagcaccaagcugcgcauggugaccgggcugcggaacauccccuccauccagagccgcggccucuucggggccaucgcgggcuucaucgagggcggguggacgggcaugaucgacgggugguacggcuaccaccaccagaacgagcagggguccggcuacgccgccgaccagaaguccacccagaacgccaucaacggcaucaccaacaaggucaacucggugaucgagaagaugaacacccaguucacggccguggggaaggaguucaacaagcuggagcggcgcauggagaaccugaacaagaaggucgacgacggcuuccucgacaucuggaccuacaacgcggagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacaacgagugcauggagagcgugaagaacgggaccuacgacuacccgaaguacagcgaggaguccaagcugaaccgcgagaagaucgacggcgucaagcucgagucgaugggcguguaccagauccuggccaucuacuccacgguggccagcucccugguccuccuggugagccugggggccaucuccuucuggaugugcagcaacggcucccuccagugccggaucugcaucuga

SEQ ID NO: 1948 - RNA, 1701 nt, Artificial Sequence
  derived and/or modified CDS sequence (AUadapt) from InfluenzaA__ABS00326__HA
augaaggccaagcugcucgugcugcugugcgccuucaccgcgaccgacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucuccaagaaguccuggucguacaucgccgagacccccaacagcgagaacgggaccugcuaccccggcuacuucgccgacuacgaggagcuccgggagcagcuguccagcgucuccagcuucgagcgcuucgagaucuuccccaaggaguccucguggccgaaccacacggugaccaagggcguguccgccagcugcucccacaagggccggagcuccuucuaccgcaaccugcucuggcugaccgagaagaacgggagcuaccccaaccugucgaaguccuacgucaacaacaaggagaaggaggugcucgugcuguggggcguccaccaccccagcaacaucggggagcagcgggccaucuaccacaccgagaacgcguacguguccguggucagcucccacuacaaccgccgguucacgcccgagaucgccaagcgcccgaaggugcggggccaggagggccgcaucaacuacuacuggacccugcucgagcccggggacaccaucaucuucgaggccaacggcaaccugaucgcccccugguacgccuucgcgcugagccggggguucggcuccggcaucaucaccucgaacgccuccauggacgagugcgacgccaagugccagacgccccagggggccaucaacagcucccucccguuccagaacgugcaccccgucaccaucggcgagugccccaaguacgugcgcagcaccaagcugcggauggugaccgggcugcgcaacauccccuccauccagagccggggccucuucggggccaucgcgggcuucaucgagggcggguggacgggcaugaucgacgggugguacggcuaccaccaccagaacgagcagggguccggcuacgccgccgaccagaaguccacccagaacgccaucaacggcaucaccaacaaggucaacucggugaucgagaagaugaacacccaguucacggccguggggaaggaguucaacaagcuggagcgccggauggagaaccugaacaagaaggucgacgacggcuuccucgacaucuggaccuacaacgcggagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacaacgagugcauggagagcgugaagaacgggaccuacgacuacccgaaguacagcgaggaguccaagcugaaccgggagaagaucgacggcgucaagcucgagucgaugggcguguaccagauccuggccaucuacuccacgguggccagcucccugguccuccuggugagccugggggccaucuccuucuggaugugcagcaacggcucccuccagugccgcaucugcaucuga

SEQ ID NO: 1949 - RNA, 1701 nt, Artificial Sequence; identical to SEQ ID NO: 1885
  derived and/or modified CDS sequence (AUadapt) from InfluenzaA__ABS49899__HA

SEQ ID NO: 1950 - RNA, 1701 nt, Artificial Sequence
  derived and/or modified CDS sequence (AUadapt) from InfluenzaA__ABS49910__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagucguccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagaugcgggagaacgccgaggacauggggaacggcugcuucaagaucuaccacaagugcgacaacgccugcaucgaguccauccgcaacggcaccuacgaccacgacguguaccgcgacgaggcccugaacaaccgguuccagaucaagggggucgagcucaagucgggcuacaaggacuggauccuguggaucuccuucgcgaucagcugcuuccugcucugcguggugcugcugggguucaucaugugggccugccagcgcggcaacauccggugcaacaucugcaucuga

SEQ ID NO: 1951 - RNA, 1701 nt, Artificial Sequence; identical to SEQ ID NO: 895
  derived and/or modified CDS sequence (AUadapt) from InfluenzaA__ABS49965__HA

SEQ ID NO: 1952 - RNA, 1698 nt, Artificial Sequence
  derived and/or modified CDS sequence (AUadapt) from InfluenzaA__ABS49976__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacaacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 1953 - RNA, 1698 nt, Artificial Sequence
  derived and/or modified CDS sequence (AUadapt) from InfluenzaA__ABS49987__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacaugaagaaccuguacgagaaggugaagucccagcugaagaacaacgcgaaggagaucgggaacggcugcuucgaguucuaccacaagugcaacaacgagugcauggagagcgucaagaacgggaccuacgacuaccccaaguacuccgaggagucgaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 1954 - RNA, 1701 nt, Artificial Sequence
  derived and/or modified CDS sequence (AUadapt) from InfluenzaA__ABS49998__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccaacaagagcuucuucucccgccucaacuggcugcaccagcugaaguacaaguaccccgcgcucaacgugaucaugcccaacaacgagaaguucgacaagcuguacaucuggggcguccaccaccccucgaccgacuccgaccagaucagccuguacgcccaggccccggggcgggugacggugucgaccaagcgcucccagcagaccgucauccccaacaucggcagccggcccugggugcgcggcguguccucgcggaucuccaucuacuggaccaucgucaagcccggggacauccuccugaucaacugcacgggcaaccugaucgccccgcgcggguacuucaagauccggagcggcaaguccucgaucaugcgcuccgacgccagcaucggcaagugcaacuccgagugcaucacccccaacgggucgauccccaacgacaagcccuuccagaacgugaaccggaucaccuacggcgcgugcccgcgcuacgugaagcagaacacccucaagcuggccacggggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacccaggccgccaucaaccagaucaacggcaagcucaaccgccugaucgagaagacgaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgggagaacgcggaggacauggggaacggcugcuucaagaucuaccacaagugcgacaacgccugcaucgggucgauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 1955 - RNA, 1701 nt, Artificial Sequence
  derived and/or modified CDS sequence (AUadapt) from InfluenzaA__ABS50009__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggcccagaacgggaccuccagcgccugcaagcgccgguccaacaagucguucuucucccgccucaacuggcugcaccagcugaaguacaaguaccccgcgcucaacgugaccaugcccaacaacgagaaguucgacaagcuguacaucuggggcguccaccaccccagcacggacuccgaccagaucucgcuguacgcccaggccccggggcgggugaccgugagcaccaagcgcucccagcagaccgucauccccaacaucggcucgcggcccugggugcgcggcguguccagcaagaucuccaucuacuggacgaucgucaagcccggggacauccuccugaucaacugcaccggcaaccugaucgccccgcggggguacuucaagauccgcucgggcaaguccagcaucaugcgguccgacgccucgaucggcaagugcaacuccgagugcaucacccccaacgggagcauccccaacgacaagcccuuccagaacgugaaccgcaucaccuacggcgcgugcccgcgguacgugaagcagaacacgcucaagcuggccaccgggaugcgcaacguccccgagaagcagacccggggcaucuucggggccaucgccggcuucaucgagaacggcugggaggggaugguggacggcugguacggguuccgccaccagaacuccgagggcaccgggcaggccgcggaccugaaguccacgcaggccgccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgcggaggacauggggaacggcugcuucaagaucuaccacaagugcgacaacgccugcaucgggagcauccggaacggcaccuacgaccacgacguguaccgcgacgaggcccugaacaaccgcuuccagaucaagggggucgagcugaaguccggcuacaaggacuggauccucuggaucucguucgccaucagcugcuuccugcugugcgugguccuccugggcuucaucaugugggccugccagaaggggaacauccggugcaacaucugcaucuga

SEQ ID NO: 1956 - RNA, 1701 nt, Artificial Sequence; identical to SEQ ID NO: 955
  derived and/or modified CDS sequence (AUadapt) from InfluenzaA__ABS50020__HA

SEQ ID NO: 1957 - RNA, 1701 nt, Artificial Sequence
  derived and/or modified CDS sequence (AUadapt) from InfluenzaA__ABS50031__HA
augaagaccaucaucgcccugucguacaugcucugccugguguucgcccagaagcugcccggcaacgacaacuccaccgcgaugcucugccuggggcaccacgccgucccgaacggcacgcuggugaagaccaucaccaacgaccagaucgaggugaccaacgccacggagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacccuggaguucaacaacgagagcuucaacuggacgggcguggcccagaacgggaccuccucggccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccucgaccgacuccgaccagaucagccuguacgcccaggccccggggcgggugacggugucgaccaagcgcucccagcagaccgucauccccaacaucggcagcggccccugggugcgcgggguguccucgcggaucuccaucuacuggaccaucgucaagcccggcgacauccuccugaucaacugcacggggaaccugaucgccccgcggggcuacuucaagauccgcagcggcaaguccucgaucaugcgguccgacgccagcaucgggaagugcaacuccgagugcaucacccccaacggcucgauccccaacgacaagcccuuccagaacgugaaccgcaucaccuacggggcgugcccgcgguacgugaagcagaacacccucaagcuggccacgggcaugcgcaacguccccgagaagcagacccgggggaucuucggcgccaucgccggcuucaucgagaacgggugggagggcaugguggacgggugguacggcuuccgccaccagaacuccgaggggaccggccaggccgcggaccugaaguccacccaggccgccaucaaccagaucaacggcaagcucaaccggcugaucgagaagacgaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugaccgacuccgagaugaacaagcuguucgagcggacgaagaagcagcuccgcgagaacgcggaggacaugggcaacgggugcuucaagaucuaccacaagugcgacaacgccugcaucggcucgauccggaacgggaccuacgaccacgacguguaccgcgacgaggcccugaacaaccgcuuccagaucaagggcgucgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 1958 - RNA, 1701 nt, Artificial Sequence; identical to SEQ ID NO: 296
  derived and/or modified CDS sequence (AUadapt) from InfluenzaA__ABS50042__HA

SEQ ID NO: 1959 - RNA, 1701 nt, Artificial Sequence; identical to SEQ ID NO: 1938
  derived and/or modified CDS sequence (AUadapt) from InfluenzaA__ABS50053__HA

SEQ ID NO: 1960 - RNA, 1701 nt, Artificial Sequence
  derived and/or modified CDS sequence (AUadapt) from InfluenzaA__ABS50064__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggcgcaucugcgacagcccccaccagauccuggacggcgagaacugcacccugaucgacgcccuccugggggacccccacugcgacggcuuccagaacaaggagugggaccuguucguggagcggucgaaggccuacuccaacugcuaccccuacgacgugccggacuacgucagccuccgcucccugguggcgucguccggcacgcuggaguucaacaacgagagcuucaacuggaccgggguggcccagaacggcaccuccucggccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccuccugaucaacagcaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgugaaccgcaucaccuacggcccgugcccccgguacgucaagcagacgacccucaagcuggccaccgggaugcgcaacgugcccgagaagcagacccggggcaucuucggggccaucgccggcuucaucgagaacggcugggaggggaugauggacggcugguacggguuccgccaccagaacuccgagggcacggggcaggccgccgaccugaaguccacccaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcuggugucccucgagaaccagcacacgaucgaccugaccgacucggagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucagcuucgcgaucuccugcuuccugcugugcaucgugcuccugggcuucaucaugugggccugccagaaggggaacauccggugcaacaucugcaucuga

SEQ ID NO: 1961 - RNA, 1701 nt, Artificial Sequence
  derived and/or modified CDS sequence (AUadapt) from InfluenzaA__ABS50075__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccacaagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1962 - RNA, 1698 nt, Artificial Sequence
  derived and/or modified CDS sequence (AUadapt) from InfluenzaA__ABS71665__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagucgugguccuacaucguggagaagcccagccccgagaacgggaccugcuaccccggccacuucgccgacuacgaggagcugcgggagcagcuguccagcguguccucguucgagcgcuucgagaucuucccgaaggaguccagcuggcccaaccacacggccaccggggucuccgccagcugcucccacaacggcgagagcuccuucuacaagaaccuccuguggcugaccgggaagaacggccucuaccccaaccugucgaagagcuacgccaacaacaaggagaaggaggugcuggugcucuggggcguccaccacccgcccaacaucggcgaccagcgggcccuguaccacaccgagaacgccuacguguccguggucagcucccacuacucgcgcaaguucacgcccgagaucgcgaagcggcccaaggugcgcgaccaggagggccggaucuccuacuacuggacccugcucgagcccggggacaccaucaucuucgaggccaacggcaaccugaucgccccgcgcuacgccuucgcccugagccggggguucggcuccggcaucaucaacagcaacgcgcccauggacgagugcgacgccaagugccagacgccccagggggccaucaacuccucgcuccccuuccagaacgugcacccggucaccaucggcgagugccccaaguacgugcgcuccgccaagcugcggauggugaccgggcugcgcaacauccccagcauccagucccggggccucuucggggccaucgcgggcuucaucgagggcggguggaccggcauggucgacgggugguacggcuaccaccaccagaacgagcaggggagcggcuacgccgccgaccagaaguccacccagaacgccaucaacggcaucacgaacaaggugaacagcgugaucgagaagaugaacacccaguucaccgccgucgggaaggaguucaacaagcuggagcgccggauggagaaccugaacaagaagguggacgacggcuucaucgacaucuggaccuacaacgcggagcuccugguccugcucgagaacgagcgcacgcuggacuuccacgacuccaacgugaagaaccuguacgagaaggucaagucgcagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcuggaguccaugggcguguaccagauccucgccaucuacucgaccgucgccuccagccuggugcugcucgugucccugggggccaucagcuucuggaugugcuccaacggcagccugcagugccgcaucugcaucuga

SEQ ID NO: 1963 - RNA, 1698 nt, Artificial Sequence
  derived and/or modified CDS sequence (AUadapt) from InfluenzaA__ABS71666__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagucgugguccuacaucguggagaagcccagccccgagaacgggaccugcuaccccggccacuucgccgacuacgaggagcugcgggagcagcuguccagcguguccucguucgagcgcuucgagaucuucccgaaggaguccagcuggcccaaccacacggccaccggggucuccgccagcugcucccacaacggcaagagcuccuucuacaagaaccuccuguggcugaccgggaagaacggccucuaccccaaccugucgaagagcuacgccaacaacaaggagaaggaggugcuggugcucuggggcguccaccacccgcccaacaucggcgaccagcgggcccuguaccacaccgagaacgccuacguguccguggucagcucccacuacucgcgcaaguucacgcccgagaucgcgaagcggcccaaggugcgcgaccaggagggccggaucuccuacuacuggacccugcucgagcccggggacaccaucaucuucgaggccaacggcaaccugaucgccccgcgcuacgccuucgcccugagccggggguucggcuccggcaucaucaacagcaacgcgcccauggacgagugcgacgccaagugccagacgccccagggggccaucaacuccucgcuccccuuccagaacgugcacccggucaccaucggcgagugccccaaguacgugcgcuccgccaagcugcggauggugaccgggcugcgcaacauccccagcauccagucccggggccucuucggggccaucgcgggcuucaucgagggcggguggaccggcauggucgacgggugguacggcuaccaccaccagaacgagcaggggagcggcuacgccgccgaccagaaguccacccagaacgccaucaacggcaucacgaacaaggugaacagcgugaucgagaagaugaacacccaguucaccgccgucgggaaggaguucaacaagcuggagcgccggauggagaaccugaacaagaagguggacgacggcuucaucgacaucuggaccuacaacgcggagcuccugguccugcucgagaacgagcgcacgcuggacuuccacgacuccaacgugaagaaccuguacgagaaggucaagucgcagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcuggaguccaugggcguguaccagauccucgccaucuacucgaccgucgccuccagccuggugcugcucgugucccugggggccaucagcuucuggaugugcuccaacggcagccugcagugccgcaucugcaucuga

SEQ ID NO: 1964 - RNA, 1698 nt, Artificial Sequence
  derived and/or modified CDS sequence (AUadapt) from InfluenzaA__ABS71667__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagucgugguccuacaucguggagaagcccagccccgagaacgggaccugcuaccccggccacuucgccgacuacgaggagcugcgggagcagcuguccagcguguccucguucgagcgcuucgagaucuucccgaaggaguccagcuggcccaaccacacggccaccggggucuccgccagcugcucccacaacggcaagagcuccuucuacaagaaccuccuguggcugaccgggaagaacggccucuaccccaaccugucgaagagcuacgccaacaacaaggagaaggaggugcuggugcucuggggcguccaccacccgcccaacaucggcgaccagcgggcccuguaccacaccgagaacgccuacaucuccguggugagcucccacuacucgcgcaaguucacgcccgagaucgcgaagcggcccaagguccgcgaccaggagggccggaucuccuacuacuggacccugcucgagcccggggacaccaucaucuucgaggccaacggcaaccugaucgccccgcgcuacgccuucgcccugagccggggguucggcuccggcaucaucaacagcaacgcgcccauggacgagugcgacgccaagugccagacgccccagggggccaucaacuccucgcuccccuuccagaacgugcacccggugaccaucggcgagugccccaaguacguccgcuccgccaagcugcggauggugaccgggcugcgcaacauccccagcauccagucccggggccucuucggggccaucgcgggcuucaucgagggcggguggaccggcaugguggacgggugguacggcuaccaccaccagaacgagcaggggagcggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccugaacaagaaggucgacgacggcuucaucgacaucuggaccuacaacgcggagcuccuggugcugcucgagaacgagcgcacgcuggacuuccacgacuccaacgucaagaaccuguacgagaaggucaagucgcagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcuggaguccaugggcguguaccagauccucgccaucuacucgaccguggccuccagccugguccugcucgugucccugggggccaucagcuucuggaugugcuccaacggcagccugcagugccgcaucugcaucuga

SEQ ID NO: 1965 - RNA, 1698 nt, Artificial Sequence
  derived and/or modified CDS sequence (AUadapt) from InfluenzaA__ABS71668__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagucgugguccuacaucguggagaagcccagccccgagaacgggaccugcuaccccggccacuucgccgacuacgaggagcugcgggagcagcuguccagcguguccucguucgagcgcuucgagaucuucccgaaggaguccagcuggcccaaccacacggccuccggggucagcgccuccugcagccacaacggcaaguccucguucuacaagaaccuccuguggcugaccgggaagaacggccucuaccccaaccugagcaaguccuacgccaacaacaaggagaaggaggugcuggugcucuggggcguccaccacccgcccaacaucggcgaccagcgggcccuguaccacaccgagaacgccuacgugagcguggucuccucgcacuacucccgcaaguucacccccgagaucgcgaagcggcccaaggugcgcgaccaggagggccggaucaacuacuacuggacgcugcucgagcccggggacaccaucaucuucgaggccaacggcaaccugaucgccccgcgcuacgccuucgcccugagccggggguucggcuccggcaucaucaacagcaacgcgcccauggacgagugcgacgccaagugccagacgccccagggggccaucaacuccucgcuccccuuccagaacgugcacccggucaccaucggcgagugccccaaguacgugcgcuccgccaagcugcggauggugaccgggcugcgcaacauccccagcauccagucccggggccucuucggggccaucgcgggcuucaucgagggcggguggaccggcauggucgacgggugguacggcuaccaccaccagaacgagcaggggagcggcuacgccgccgaccagaaguccacccagaacgccaucaacggcaucaccaacaaggugaacagcgugaucgagaagaugaacacgcaguucaccgccgucgggaaggaguucaacaagcuggagcgccggauggagaaccugaacaagaagguggacgacggcuucaucgacaucuggaccuacaacgcggagcuccugguccugcucgagaacgagcgcacccuggacuuccacgacuccaacgugaagaaccuguacgagaaggucaagucgcagcucaagaacaacgccaaggagaucgggaacggcugcuucgaguucuaccacaagugcaacgacgagugcauggaguccgugaagaacgggacguacgacuaccccaaguacagcgaggagagcaagcugaaccgggagaagaucgacggcgugaagcuggaguccaugggcguguaccagauccucgccaucuacucgaccgucgccuccagccuggugcugcucgugucccugggggccaucagcuucuggaugugcuccaacggcagccugcagugccgcaucugcaucuga

SEQ ID NO: 1966 - RNA, 1698 nt, Artificial Sequence
  derived and/or modified CDS sequence (AUadapt) from InfluenzaA__ABS71669__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 1967 - RNA, 1698 nt, Artificial Sequence
  derived and/or modified CDS sequence (AUadapt) from InfluenzaA__ABS71671__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagauguucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgcgcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 1968 - RNA, 1698 nt, Artificial Sequence
  derived and/or modified CDS sequence (AUadapt) from InfluenzaA__ABS71672__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcggcucuccagcguguccagcuucgagcgcuucgagauguucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgcccagcgggcccuguaccacaccgagaacgccuacgugagcgucgugucgucccacuacagccgcaaguucacgcccgagaucgcgaagcggcccaaggugcgcgaccaggagggccggaucaacuacuacuggacccuccuggagcccggggacaccaucaucuucgaggccaacggcaaccugaucgccccgcgcuacgccuucgcccucucccggggguucggcagcggcaucaucaacuccaacgcgcccauggacgagugcgacgccaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgcggagcugcuggugcuccuggagaacgagcgcacgcuggacuuccacgacucgaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgggagaagaucgacggcgugaagcucgagagcaugggcgucuaccagauccuggccaucuacucgaccguggccuccagccuggugcuccuggucucccugggggccaucagcuucuggaugugcuccaacggcagccuccagugccgcaucugcaucuga

SEQ ID NO: 1969 - RNA, 1698 nt, Artificial Sequence
  derived and/or modified CDS sequence (AUadapt) from InfluenzaA__ABS71673__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggccgcucguccuucuaccggaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacaccuacgugagcgucgugagcucccacuacagccggcgcuucacccccgagaucgccaagcggcccaaggugcgcgaccaggagggccggaucaacuacuacuggacccuccuggagcccggggacacgaucaucuucgaggccaacggcaaccugaucgcgccgcgcuucgccuucgcccucucccggggguucggcucgggcaucaucaccuccaacgcccccauggacgagugcgacgccaagugccagacgccccagggggcgaucaacagcucccugcccuuccagaacguccacccggugaccaucggcgagugccccaaguacgugcgcagcgccaagcugcggauggccaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacucggugaucgagaagaugaacacgcaguucaccgccgucgggaaggaguucagcaagcuggagcgccggauggagaaccucaacaagaagguggacgacggcuuccuggacaucuggaccuacaacgccgagcugcucguccugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggacguacgacuaccccaaguacagcgaggaguccaagcucaaccgggagaagaucgacggcgugaagcuggagucgaugggcguguaccagauccuggccaucuacagcaccgucgccuccagccucgugcugcuggugucccucggggccaucagcuucuggaugugcuccaacggcagccugcagugccgcaucugcaucuga

SEQ ID NO: 1970 - RNA, 1701 nt, Artificial Sequence; identical to SEQ ID NO: 875
  derived and/or modified CDS sequence (AUadapt) from InfluenzaA__ABS71674__HA

SEQ ID NO: 1971 - RNA, 1701 nt, Artificial Sequence
  derived and/or modified CDS sequence (AUadapt) from InfluenzaA__ABS71675__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggcccacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1972 - RNA, 1701 nt, Artificial Sequence
  derived and/or modified CDS sequence (AUadapt) from InfluenzaA__ABS71676__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucgaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccucgggccgcaucaccguguccacgaagcggagccagcagaccgugaucccgaacaucgggucgcgcccccggguccgcaacauccccucccggaucagcaucuacuggaccaucgugaagcccggcgacauccugcugaucaacuccaccgggaaccucaucgccccgcgcggcuacuucaucauccggucgggcaaguccagcaucaugcgcuccgacgcccccaucgggaagugcaacucggagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagucgggguacaaggacuggauccuguggaucuccuucgccaucagcugcuuccugcucugcguggcccugcugggcuucaucaugugggccugccagaaggggaacauccggugcaacaucugcaucuga

SEQ ID NO: 1973 - RNA, 1701 nt, Artificial Sequence
  derived and/or modified CDS sequence (AUadapt) from InfluenzaA__ABS71677__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccgacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucgaacaacuccuucuucucgcggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagcggucgcagcagaccgugaucccgaacaucgggagccgcccccggguccgcaacauccccucccggaucucgaucuacuggaccaucgugaagcccggcgacauccugcugaucaacuccaccgggaaccucaucgccccgcgcggcuacuucaagauccggagcggcaaguccucgaucaugcgcuccgacgcccccaucgacaagugcaacucggagugcaucacgcccaacggguccauccccaacgacaagccguuccagaacgugaaccggaucaccuacggcgccugcccccgcuacgucaagcagaacacccugaagcuggcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccucaaguccacccaggcggccaucgaccagaucaacggcaagcugaaccgccugaucggcaagaccaacgagaaguuccaccagaucgagaaggaguucucggaggucgaggggcggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgcuuccagaucaagggcguggagcucaagucgggcuacaaggacuggauccuguggaucuccuucgccaucagcugcuuccugcucugcguggcccugcugggguucaucaugugggccugccagaagggcaacauccggugcaacaucugcaucuga

SEQ ID NO: 1974 - RNA, 1701 nt, Artificial Sequence
  derived and/or modified CDS sequence (AUadapt) from InfluenzaA__ABS71679__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgcggcuccaacaacagcuucuucucccggcugaacuggcucacgcacucgaaguucaaguaccccgcccugaacgugaccaugcccaacaacgaggaguucgacaagcuguacaucuggggcguccaccaccccgggaccgacaacgaccagaucuuccucuacgcgcaggccuccggccgcaucaccgugagcacgaagcggucgcagcagaccgugaucccgaacaucgggucccgcccccggguccgcaacauccccagccggaucuccaucuacuggaccaucgugaagcccggcgacauccugcugaucaacucgaccgggaaccucaucgccccgcgcggcuacuucaagauccgguccggcaagagcuccaucaugcgcucggacgcccccaucgggaagugcaacuccgagugcaucacgcccaacggcagcauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagucgacccaggcggccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccggugcaacaucugcaucuga

SEQ ID NO: 1975 - RNA, 1701 nt, Artificial Sequence; identical to SEQ ID NO: 1974
  derived and/or modified CDS sequence (AUadapt) from InfluenzaA__ABS71680__HA

SEQ ID NO: 1976 - RNA, 1701 nt, Artificial Sequence
  derived and/or modified CDS sequence (AUadapt) from InfluenzaA__ABS71682__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucuuccuguacgcgcaggccagcggccggaucaccgucuccacgaagcgcucgcagcagaccgugaucccgaacaucggcagccggccccgcgugcggaacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggugcugcucggguucaucaugugggccugccagaagggcaacauccgcugcaacaucugcaucuga

SEQ ID NO: 1977 - RNA, 1701 nt, Artificial Sequence
  derived and/or modified CDS sequence (AUadapt) from InfluenzaA__ABU80177__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccagcuccggcacccuggaguucaacaacgagucguucaacuggaccggcguggcccagaacgggaccuccagcuccugcaagcggcgcucgaucaaguccuucuucagccggcucaacuggcugcaccagcugaaguacaaguaccccgcccucaacgucacgaugcccaacaacgagaaguucgacaagcuguacaucuggggcgugcaccaccccuccaccgacagcgaccagaucucgcuguacgcgcaggccuccgggcgcgugaccgucagcaccaagcggucccagcagacggugaucccgaacaucggcucgcgccccugggugcgcggggucuccagccggaucuccaucuacuggaccaucgugaagcccggcgacauccuccugaucaacucgaccggcaaccugaucgcgccccggggguacuucaagauccgcuccggcaagagcuccaucaugcggagcaacgccccgaucgggaagugcaacuccgagugcaucacccccaacggcucgauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgccgaccugaaguccacccaggcggccaucaaccagaucaacggcaagcucaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacggcugcuucaagaucuaccacaagugcgacaacgcgugcaucgggucgauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 1978 - RNA, 1698 nt, Artificial Sequence
  derived and/or modified CDS sequence (AUadapt) from InfluenzaA__ABU80298__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccucgugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacucgucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggccgucgggaaggaguucaacaagcuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacaagaaggugaagucccagcugaagaacaacgccaaggagaucgggaacggcugcuucgaguucuaccacaagugcaacaacgagugcauggagagcgucaagaacgggaccuacgacuaccccaaguacuccgaggagagcaagcucaaccgcgagaagaucgacggcgugaagcuggaguccaugggcguguaccagauccuggccaucuacucgacggucgccagcucccucgugcugcuggugagccucggggccaucuccuucuggaugugcagcaacggcucccugcagugccggaucugcaucuga

SEQ ID NO: 1979 - RNA, 1701 nt, Artificial Sequence
  derived and/or modified CDS sequence (AUadapt) from InfluenzaA__ABU80320__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacucguuccagaacaaggagugggaccuguucguggagcgcuccaaggccuacagcaacugcuaccccuacgacgugccggacuacgcgucccuccggucgcuggucgccuccagcggcacgcuggaguucaacaacgaguccuucaacuggaccgggguggcccagaacggcaccagcuccgccugcaagcgccggucgaacaaguccuucuucagccgccucaacuggcugcaccagcugaaguacaaguaccccgcgcucaacgugaccaugcccaacaacgagaaguucgacaagcuguacaucuggggcguccaccaccccuccacggacucggaccagaucagccuguacgcccaggccccggggcgggugaccguguccaccaagcgcucgcagcagaccgucauccccaacaucgggucccggcccugggugcgcggcgugagcuccaucaucagcaucuacuggacgaucgucaagcccggcgacauccuccugaucaacugcaccgggaaccugaucgccccgcggggcuacuucaagauccgcuccgggaaguccuccaucaugcggucggacgccuccaucggcaagugcaacagcgagugcaucacccccaacggcuccauccccaacgacaagcccuuccagaacgugaaccgcaucaccuacggggcgugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacucggaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagcggaccaagaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgcuuccagaucaagggcgucgagcucaagagcggguacaaggacuggauccuguggaucagcuucgccaucuccugcuuccugcugugcgugguccuccugggcuucaucaugugggccugccagaagggcaacauccggugcaacaucugcaucuga

SEQ ID NO: 1980 - RNA, 1701 nt, Artificial Sequence; identical to SEQ ID NO: 1284
  derived and/or modified CDS sequence (AUadapt) from InfluenzaA__ABU80331__HA

SEQ ID NO: 1981 - RNA, 1701 nt, Artificial Sequence; identical to SEQ ID NO: 122
  derived and/or modified CDS sequence (AUadapt) from InfluenzaA__ABU80400__HA

SEQ ID NO: 1982 - RNA, 1701 nt, Artificial Sequence
  derived and/or modified CDS sequence (AUadapt) from InfluenzaA__ABU92572__HA
augaagaccaucaucgcccugucguacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagucguccagcaccgggcgcaucugcgacucgccccaccagauccuggacggcgagaacugcacgcugaucgacgcccuccugggggacccccacugcgacggcuuccagaacaaggagugggaccuguucguggagcggagcaaggccuacuccaacugcuaccccuacgacgugccggacuacgucucgcuccgcucccugguggccagcuccggcacccuggaguucaacaacgagucguucaacuggaccgggguggcgcagaacggcaccuccagcgccugcaagcggcgcuccgacaagucguucuucucccggcucaacuggcugcaccagcugaaguacaaguaccccgcccucaacgucacgaugcccaacaacgagaaguucgacaagcuguacaucuggggcgugcaccaccccgggaccgacagcgaccagaucucccuguacgcccaggcgucggggcgcgugaccgucagcaccaagcggucccagcagacggugaucccgaacaucggcucgcgccccugggugcggggcgucuccagccgcaucuccaucuacuggaccaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucacguacggcccgugcccccgguacgucaagcagaacacccucaagcuggccaccgggaugcgcaacgugcccgagaagcagacccggggcaucuucggggccaucgccggcuucaucgagaacggcugggaggggaugauggacggcugguacggguuccgccaccagaacuccgagggcacggggcaggccgccgaccugaaguccacccaggccgccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggucguacaacgcggagcugcugguggcccucgagaaccagcacacgaucgaccugaccgacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcccugaacaaccgcuuccagaucaagggggucgagcugaaguccggcuacaaggacuggauccucuggaucucguucgcgaucagcugcuuccugcugugcaucgugcuccugggcuucaucaugugggccugccagaaggggaacauccggugcaacaucugcaucuga

SEQ ID NO: 1983 - RNA, 1701 nt, Artificial Sequence
  derived and/or modified CDS sequence (AUadapt) from InfluenzaA__ABU92573__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgcgccccugggugcggggcgucuccagccgcaucuccaucuacuggacgaucgugaagcccggggacauccuccugaucaacucgaccggcaaccugaucgcgccccggggguacuucaagauccgcuccggcaagagcuccaucaugcggucggacgccccgaucggcaagugcaacuccgagugcaucacccccaacgggagcauccccaacggcaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugauggacgggugguacggcuuccgccaccagaacuccgaggggaccggccaggccgccgaccugaaguccacgcaggcggccaucaaccagaucaacggcaagcucaaccggcugaucaagaagaccaacgagaaguuccaccagaucgagaaggaguucuccgagguggaggggcgcauccaggaccuggagaaguacgucgaggacaccaagaucgaccucuggucguacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacuggauccucuggaucucguucgccaucagcugcuuccugcugugcaucgugcuccugggguucaucaugugggccugccagaagggcaacauccggugcaacaucugcaucuga

SEQ ID NO: 1984 - RNA, 1701 nt, Artificial Sequence
  derived and/or modified CDS sequence (AUadapt) from InfluenzaA__ABU92575__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccucggggcgcgugaccgucagcaccaagcggucccagcagaccgugaucccgaacaucggcucgaagcccugggugcgcggcgucuccagccggaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgccugcaucgggagcauccgcaacggcaccuacgaccacgacguguaccgcgacgaggcgcugaacaaccgguuccagaucaagggggucgagcugaaguccggcuacaaggacuggauccucuggaucucguucgccaucagcugcuuccugcugugcaucgugcuccugggcuucaucaugugggccugccagaaggggaacauccgcugcaacaucugcaucuga

SEQ ID NO: 1985 - RNA, 1701 nt, Artificial Sequence; identical to SEQ ID NO: 296
  derived and/or modified CDS sequence (AUadapt) from InfluenzaA__ABU92576__HA

SEQ ID NO: 1986 - RNA, 1701 nt, Artificial Sequence; identical to SEQ ID NO: 296
  derived and/or modified CDS sequence (AUadapt) from InfluenzaA__ABU92577__HA

SEQ ID NO: 1987 - RNA, 1701 nt, Artificial Sequence; identical to SEQ ID NO: 317
  derived and/or modified CDS sequence (AUadapt) from InfluenzaA__ABU92578__HA

SEQ ID NO: 1988 - RNA, 1701 nt, Artificial Sequence; identical to SEQ ID NO: 317
  derived and/or modified CDS sequence (AUadapt) from InfluenzaA__ABU92579__HA

SEQ ID NO: 1989 - RNA, 1701 nt, Artificial Sequence; identical to SEQ ID NO: 317
  derived and/or modified CDS sequence (AUadapt) from InfluenzaA__ABU92580__HA

SEQ ID NO: 1990 - RNA, 1701 nt, Artificial Sequence; identical to SEQ ID NO: 1982
  derived and/or modified CDS sequence (AUadapt) from InfluenzaA__ABU92581__HA

SEQ ID NO: 1991 - RNA, 1701 nt, Artificial Sequence
  derived and/or modified CDS sequence (AUadapt) from InfluenzaA__ABU92582__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccucggccugcaagcggcgcuccgacaagagcuucuucucccggcucaacuggcugcaccagcugaaguacaaguaccccgcccagaacgucaccaugcccaacaacgagaaguucgacaagcucuacaucuggggcgugcaccaccccgggacggacucggaccagaucucccuguacgcgcaggccagcgggcgcgugaccgucucgaccaagcggucccagcagaccgugaucccgaacaucggcagccgccccugggugcggggcgucuccucgcgcaucuccaucuacuggacgaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacccccaacgggagcauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcugaaccggcucaucgagaagaccaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucacggacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucucguucgccaucagcugcuuccuccugugcaucgugcugcucggcuucaucaugugggccugccagaaggggaacauccggugcaacaucugcaucuga

SEQ ID NO: 1992 - RNA, 1701 nt, Artificial Sequence; identical to SEQ ID NO: 1991
  derived and/or modified CDS sequence (AUadapt) from InfluenzaA__ABU92583__HA

SEQ ID NO: 1993 - RNA, 1701 nt, Artificial Sequence
  derived and/or modified CDS sequence (AUadapt) from InfluenzaA__ABU92584__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucucgcuccgcucccugguggcgagcuccggcacgcuggaguucaacaacgagucguucaacuggaccgggguggcccagaacggcaccuccagcgccugcaagcggcgcuccgacaagucguucuucucccggcucaacuggcugcaccagcugcgcuacaaguaccccgcccucaacgucaccaugcccaacaacgagaaguucgacaagcuguacaucuggggcgugcaccaccccgggacggacagcgaccagaucucccuguacgcgcaggccucggggcgggugaccgucagcaccaagcgcucccagcagaccgugaucccgaacaucggcucgcggcccugggugcgcggcgucuccagccggaucuccaucuacuggacgaucgugaagcccggggacauccuccugaucaacucgaccggcaaccugaucgcgccccgcggguacuucaagauccgguccggcaagagcuccaucaugcgcucggacgccccgaucggcaagugcaacuccgagugcaucacccccaacgggagcauccccaacgacaagcccuuccagaacgugaaccggaucaccuacggcgccugcccgcgcuacgucaagcagaagacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugacggacuccgagaugaacaagcuguucgagcgcaccaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgguuccagaucaagggggucgagcugaaguccggcuacaaggacuggauccucuggaucucguucgccaucagcugcuuccugcugugcaucgugcuccugggcuucaucaugugggccugccagaaggggaacauccgcugcaacaucugcaucuga

SEQ ID NO: 1994 - RNA, 1701 nt, Artificial Sequence
  derived and/or modified CDS sequence (AUadapt) from InfluenzaA__ABU92586__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccucgggccggaucaccgucagcacgaagcgcucccagcagaccgugaucccgaacaucggcucgcggccccgcgugcgggacauccccucccgcaucagcaucuacuggaccaucgucaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaagaacuggauccuguggaucuccuucgccaucagcugcuuccuccugugcguggcccugcucggguucaucaugugggccugccagaagggcaacauccggugcaacaucugcaucuga

SEQ ID NO: 1995 - RNA, 1701 nt, Artificial Sequence
  derived and/or modified CDS sequence (AUadapt) from InfluenzaA__ABU92587__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccucgggccggaucaccgucagcacgaagcgcucccagcagaccgccaucccgaacaucggcucgcggccccgcgugcgggacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgucaaccgcaucaccuacggcgcgugcccccgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaucgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacucggagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggcgugccagaagggcaacauccggugcaacaucugcaucuga

SEQ ID NO: 1996 - RNA, 1701 nt, Artificial Sequence
  derived and/or modified CDS sequence (AUadapt) from InfluenzaA__ABU92588__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgcaaguccaacaacucguucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugucgacgaagcggagccagcagaccgugaucccgaacaucggcucccgcccccggguccgcgacauccccucgcggaucuccaucuacuggaccaucgugaagcccggggacauccugcucaucaacagcaccggcaaccugaucgccccgcgcggguacuucaagauccgguccggcaagucguccaucaugcgcucggacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccucaagucgacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgaguuccucguggcccuggagaaccagcacacgaucgaccugaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggaccuacgaccacgacgucuaccgcgacgaggcccugaacaaccgguuccagaucaagggcguggagcucaaguccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 1997 - RNA, 1701 nt, Artificial Sequence; identical to SEQ ID NO: 878
  derived and/or modified CDS sequence (AUadapt) from InfluenzaA__ABU92590__HA

SEQ ID NO: 1998 - RNA, 1701 nt, Artificial Sequence
  derived and/or modified CDS sequence (AUadapt) from InfluenzaA__ABU92591__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccucgggccggaucaccgucagcacgaagcgcucccagcagaccgugaucccgaacaucggcucgcggccccgcgugcgggacauccccucccgcaucagcaucuacuggaccaucgucaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 1999 - RNA, 1701 nt, Artificial Sequence; identical to SEQ ID NO: 1998
  derived and/or modified CDS sequence (AUadapt) from InfluenzaA__ABU92592__HA

SEQ ID NO: 2000 - RNA, 1701 nt, Artificial Sequence
  derived and/or modified CDS sequence (AUadapt) from InfluenzaA__ABU92593__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccggccagaaggggaacaagcgcugcaacaucugcaucuga

SEQ ID NO: 2001 - RNA, 1701 nt, Artificial Sequence
  derived and/or modified CDS sequence (AUadapt) from InfluenzaA__ABU92594__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagagcugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugucgacgaagcgcucgcagcagaccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucucguucgccaucuccugcuuccuccugugcguggcccugagcggcuucaucaugugggccugccagaaggggaacauccggugcaacaucugcaucuga

SEQ ID NO: 2002 - RNA, 1701 nt, Artificial Sequence
  derived and/or modified CDS sequence (AUadapt) from InfluenzaA__ABU92595__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgggaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2003 - RNA, 1701 nt, Artificial Sequence
  derived and/or modified CDS sequence (AUadapt) from InfluenzaA__ABU92596__HA
augaagaccaucaucgcccugucguacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucaucgccucguccggcacgcuggaguucaacaacgagucguucaacuggaccggggucacccagaacggcaccuccagcgccugcaagcgccgguccgacaacucguucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucucgcuguacgcgcaggccuccgggcggaucaccgucagcacgaagcgcucgcagcagaccgugaucccgaacaucggcucccggccccgcgugcgggacauccccucgcgcaucuccaucuacuggaccaucgucaagcccggcgacauccugcucaucaacagcaccgggaaccugaucgccccgcggggcuacuucaagauccgcuccgggaaguccuccaucaugcggucggacgcccccaucggcaagugcaacuccggcugcaucacgcccaacgggucgauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 2004 - RNA, 1701 nt, Artificial Sequence; identical to SEQ ID NO: 875
  derived and/or modified CDS sequence (AUadapt) from InfluenzaA__ABU92597__HA

SEQ ID NO: 2005 - RNA, 1701 nt, Artificial Sequence; identical to SEQ ID NO: 318
  derived and/or modified CDS sequence (AUadapt) from InfluenzaA__ABU92601__HA

SEQ ID NO: 2006 - RNA, 1701 nt, Artificial Sequence; identical to SEQ ID NO: 318
  derived and/or modified CDS sequence (AUadapt) from InfluenzaA__ABU92602__HA

SEQ ID NO: 2007 - RNA, 1701 nt, Artificial Sequence
  derived and/or modified CDS sequence (AUadapt) from InfluenzaA__ABU92603__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucgacuggaccggggugacccagaacggcaccucguccgccugcaagcgccggucggacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccgggcggaucaccgugagcacgaagcgcucgcagcagaccgugaucccgaacaucggcucccggccccgcguccgggacgugucgucccgcaucagcaucuacuggaccaucgugaagcccggcgacauccugcucaucaacuccaccgggaaccugaucgcgccccggggcuacuucaagauccgcucggggaaguccucgaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggaccggccaggccgccgaccugaaguccacccaggcggccaucaaccagaucaacgggaagcugaaccggcucaucggcaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagucgggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 2008 - RNA, 1701 nt, Artificial Sequence; identical to SEQ ID NO: 318
  derived and/or modified CDS sequence (AUadapt) from InfluenzaA__ABU92604__HA

SEQ ID NO: 2009 - RNA, 1701 nt, Artificial Sequence; identical to SEQ ID NO: 2007
  derived and/or modified CDS sequence (AUadapt) from InfluenzaA__ABU92605__HA

SEQ ID NO: 2010 - RNA, 1701 nt, Artificial Sequence; identical to SEQ ID NO: 2007
  derived and/or modified CDS sequence (AUadapt) from InfluenzaA__ABU92606__HA

SEQ ID NO: 2011 - RNA, 1701 nt, Artificial Sequence; identical to SEQ ID NO: 857
  derived and/or modified CDS sequence (AUadapt) from InfluenzaA__ABU92608__HA

SEQ ID NO: 2012 - RNA, 1701 nt, Artificial Sequence; identical to SEQ ID NO: 857
  derived and/or modified CDS sequence (AUadapt) from InfluenzaA__ABU92609__HA

SEQ ID NO: 2013 - RNA, 1701 nt, Artificial Sequence
  derived and/or modified CDS sequence (AUadapt) from InfluenzaA__ABU92610__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcaagcgccgguccaacaacagcuucuucucccgccugaacuggcucacgcacucgaaguucaaguaccccgcccugaacgugaccaugcccaacaacgagaaguucgacaagcuguacaucuggggcguccaccaccccgggaccgacaacgaccagaucuuccucuacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccugcugaucaacucgaccgggaaccucaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucgccuacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggaucggccaggccgcggaccucaagagcacgcaggccgccaucaaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggucguacaacgccgagcugcucguggcccuggagaaccagcacaccaucgaccugacggacuccgagaugaacaagcuguucgagcggaccaagaagcagcuccgcgagaacgcggaggacaugagcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagucgggguacaaggacuggauccuguggaucuccuucgccaucagcugcuuccugcucugcgugguccugcugggcuucaucaugugggccugccagaagggcaacauccggugcaacaucugcaucuga

SEQ ID NO: 2014 - RNA, 1701 nt, Artificial Sequence
  derived and/or modified CDS sequence (AUadapt) from InfluenzaA__ABU92611__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccucggccugcaagcgccgguccaacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucucgcuguacgcgcaggccuccggcaagaucaccgucagcacgaagcggucgcagcagaccgugaucccgaacaucggcucccgcccccgggugcgcgacauccccagccggaucuccaucuacuggaccaucgucaagcccggggacauccugcucaucaacucgaccggcaaccugaucgccccgcgcggguacuucaagauccgguccggcaagucguccaucaugcgcagcgacgcccccaucggcaagugcaacuccgagugcaucacgcccaacgggucgauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggaccuacgaccacgacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaucugggccugccugaagggcaacauccgcugcaacaucugcaucuga

SEQ ID NO: 2015 - RNA, 1701 nt, Artificial Sequence
  derived and/or modified CDS sequence (AUadapt) from InfluenzaA__ABU92612__HA
augaagaccaucaucgcccugucguacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggcccacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacauccccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacaacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 2016 - RNA, 1701 nt, Artificial Sequence; identical to SEQ ID NO: 1503
  derived and/or modified CDS sequence (AUadapt) from InfluenzaA__ABU92613__HA

SEQ ID NO: 2017 - RNA, 1701 nt, Artificial Sequence; identical to SEQ ID NO: 2002
  derived and/or modified CDS sequence (AUadapt) from InfluenzaA__ABU92614__HA

SEQ ID NO: 2018 - RNA, 1701 nt, Artificial Sequence
  derived and/or modified CDS sequence (AUadapt) from InfluenzaA__ABU92615__HA
augaagaccaucaucgcccugucguacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcggucgaaggccuacuccaacugcuaccccuacgacgugccggacuacgcgagccugcgcucccucgucgccucguccgggacgcuggaguucaacaacgagagcuucaacuggaccggcgugacccagaacgggaccuccucggccugcaagcggcgcuccaacaacucguucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugucgacgaagcggucgcagcagaccgugaucccgaacgucggcucccgcccccgggugcgcgacauccccagccggaucuccaucuacuggaccaucgugaagcccggggacauccugcucaucaacucgaccggcaaccugaucgccccgcgcggguacuucaagauccgguccggcaagagcuccaucaugcgcucggacgcccccaucggcaagugcaacuccgagugcaucacgcccaacgggucgauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcaccaagaagcagcugcgcgagaacgccgaggacaugggcaacgggugcuucaagaucuaccacaagugcgacaacgcgugcaucggcucgauccggaacgggaccuacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 2019 - RNA, 1701 nt, Artificial Sequence
  derived and/or modified CDS sequence (AUadapt) from InfluenzaA__ABU92617__HA
augaagaccaucaucgcccugucguacauccucugccugguguucgcccagaagcugcccggcaacgacaacuccaccgcgacgcucugccuggggcaccacucggucccgaacggcaccaucgugaagaccaucaccaacgaccagaucgaggugacgaacgccaccgagcugguccaguccagcuccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgccucccugcggucgcucaucgcguccagcgggacgcuggaguucaacaacgaguccuucaacuggaccggcgucacccagaacgggaccucguccgccugcaagcgccggucgaacuccagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucucgcuguacgcccaggcgagcggccggaucaccgucuccacgaagcgcucgcagcagaccgugaucccgaacaucggcucccggccccgcgugcgggacauccccagccgcaucuccaucuacuggaccaucgucaagcccggggacauccugcucaucaacucgaccggcaaccugaucgccccgcggggguacuucaagauccgcuccggcaagucguccaucaugcggagcgacgcccccaucggcaagugcaacuccgagugcaucacgcccaacgggucgauccccaacgacaagccguuccagaacgugaaccgcaucaccuacggcgccugcccccgguacgugaagcagaacacccugaagcucgccaccgggaugcgcaacguccccgagaagcagacgcggggcaucuucggggcgaucgccggcuucaucgagaacggcugggaggggaugguggacggcugguacggguuccgccaccagaacuccgagggcaucgggcaggccgccgaccucaagagcacccaggccgcgaucgaccagaucaacggcaagcugaaccggcugaucggcaagaccaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 2020 - RNA, 1701 nt, Artificial Sequence; identical to SEQ ID NO: 1503
  derived and/or modified CDS sequence (AUadapt) from InfluenzaA__ABU92619__HA

SEQ ID NO: 2021 - RNA, 1701 nt, Artificial Sequence; identical to SEQ ID NO: 2002
  derived and/or modified CDS sequence (AUadapt) from InfluenzaA__ABU92620__HA

SEQ ID NO: 2022 - RNA, 1701 nt, Artificial Sequence
  derived and/or modified CDS sequence (AUadapt) from InfluenzaA__ABU92622__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacucguccuucuucagccgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccucgggccggaucaccgucagcacgaagcgcucccagcagaccgugaucccgaacaucggcucgcggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccggucggugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 2023 - RNA, 1701 nt, Artificial Sequence; identical to SEQ ID NO: 318
  derived and/or modified CDS sequence (AUadapt) from InfluenzaA__ABU92623__HA

SEQ ID NO: 2024 - RNA, 1701 nt, Artificial Sequence
  derived and/or modified CDS sequence (AUadapt) from InfluenzaA__ABU92624__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucgacuggaccggggugacccagaacggcaccucguccgccugcaagcgccggagcgacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggcccuggggcggaucaccguguccacgaagcgcagccagcagaccgugaucccgaacaucggcucgcggccccgcguccgggacguguccucgcgcaucuccaucuacuggaccaucgugaagcccggcgacauccuccugaucaacagcaccgggaaccugaucgcgccccggggcuacuucaagauccgcuccggcaagucguccaucaugcggagcgacgccccgaucgggaagugcaacuccgagugcaucacgcccaacggcucgauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagucgacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggaccaagaagcagcuccgcgagaacgccgaggacauggggaacggcugcuucaagaucuaccacaagugcgacaacgcgugcaucgggucgauccgcaacggcacguacgaccacgacguguaccgggacgaggcccugaacaaccgcuuccagaucaaggggguggagcugaaguccggcuacaaggacuggauccucuggaucagcuucgccaucuccugcuuccugcugugcgucgcccuccugggcuucaucaugugggccugccagaaggggaacauccggugcaacaucugcaucuga

SEQ ID NO: 2025 - RNA, 1701 nt, Artificial Sequence; identical to SEQ ID NO: 2007
  derived and/or modified CDS sequence (AUadapt) from InfluenzaA__ABU92625__HA

SEQ ID NO: 2026 - RNA, 1701 nt, Artificial Sequence; identical to SEQ ID NO: 318
  derived and/or modified CDS sequence (AUadapt) from InfluenzaA__ABU92626__HA

SEQ ID NO: 2027 - RNA, 1701 nt, Artificial Sequence
  derived and/or modified CDS sequence (AUadapt) from InfluenzaA__ABU92627__HA
augaagaccaucaucgcccugucguacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaucucguccaccggggagaucugcgacagcccccaccagauccuggacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggucgcuggucgccuccagcggcacgcucgaguucaacaacgaguccuucgacuggaccggggugacccagaacggcaccucguccgccugcaagcgccggucggacaaguccuucuucagccgccugaacuggcugacgcaccucaaguacaaguaccccgcccugaacgugaccaugcccaacaacgagaaguucgacaagcuguacaucuggggcguccaccaccccgggaccgacuccgaccagaucucgcucuacgcgcaggccuccgggcggaucaccgugucgacgaagcgcagccagcagaccgugaucccgaacaucggcucccggccccgcguccgggacgugucgucccgcaucucgaucuacuggaccaucgugaagcccggcgacauccugcugaucaaccggcccgggaaccucaucgccccgcgcggcuacuucaagauccgguccggcaagagcuccaucaugcgcucggacgcccccaucgggaagugcaacuccgagugcaucacccccaacggcucgauccccaacgacaagccguuccagaacgucaaccggaucacguacggggccugcccccgcuacgugaagcagaacacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggacgggccaggccgccgaccucaagagcacccaggcggccaucaaccagaucaacgggaagcugaaccgccugaucggcaagaccaacgagaaguuccaccagaucgagaaggaguucuccgagguggagggccggauccaggaccucgagaaguacguggaggacaccaagaucgaccuguggucguacaacgccgagcugcucgucgcccuggagaaccagcacacgaucgaccugaccgacuccgagaugaacaagcuguucgagcgcaccaagaagcagcuccgcgagaacgccgaggacauggggaacggcugcuucaagaucuaccacaagugcgacaacgcgugcaucgggucgauccggaacggcaccuacgaccacgacguguaccgcgacgaggcccugaacaaccgguuccagaucaaggggguggagcucaaguccggcuacaaggacuggauccuguggaucagcuucgccaucuccugcuuccugcucugcgucgcccugcugggcuucaucaugugggccugccagaaggggaacauccgcugcaacaucugcaucuga

SEQ ID NO: 2028 - RNA, 1701 nt, Artificial Sequence; identical to SEQ ID NO: 2007
  derived and/or modified CDS sequence (AUadapt) from InfluenzaA__ABU92628__HA

SEQ ID NO: 2029 - RNA, 1701 nt, Artificial Sequence; identical to SEQ ID NO: 2007
  derived and/or modified CDS sequence (AUadapt) from InfluenzaA__ABU92631__HA

SEQ ID NO: 2030 - RNA, 1701 nt, Artificial Sequence
  derived and/or modified CDS sequence (AUadapt) from InfluenzaA__ABU92632__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcgugcaccaccccgggaccgacagcgaccagaucucccuguacgcgcaggccucgggccggaucaccgucagcacgaagcgcucccagcagaccgugaucccgaacaucggcucgcggccccgcgugcgggacgucuccucgcgcaucuccaucuacuggaccaucgugaagcccggggacauccugcucaucaacagcaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccugaacuccgagggcaccgggcaggccgccgaccugaaguccacccaggcggccaucaaccagaucaacggcaagcucaaccggcugaucggcaagaccaacgagaaguuccaccagaucgagaaggaguucuccgaggucgaggggcgcauccaggaccuggagaaguacguggaggacacgaagaucgaccucuggucguacaacgccgagcugcugguggcccucgagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacgucuaccgggacgaggcccugaacaaccgcuuccagaucaagggcguggagcugaaguccggcuacaaggacuggauccucuggaucucguucgccaucagcugcuuccugcugugcguggcccuccugggguucaucaugugggccugccagaagggcaacauccggugcaacaucugcaucuga

SEQ ID NO: 2031 - RNA, 1701 nt, Artificial Sequence
  derived and/or modified CDS sequence (AUadapt) from InfluenzaA__ABU92635__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcgguccaucgucgccucguccgggacgcucgaguucaacaacgagagcuucaacuggaccggcgugacccagaacgggaccuccucggccugcaagcgcaaguccaacaagucguucuucucccggcugaacuggcugacgcaccucaaguacaaguaccccgcccugaacgugaccaugcccaacaacgagaaguucgacaagcuguacaucuggggcguccaccaccccgggaccgacaacgaccagaucagccucuacgcgcaggccuccggccgcaucaccgugucgacgaagcggucgcagcagaccgugaucccgaacaucggcucccgcccccggguccgcgacgugagcucccggaucucgaucuacuggaccaucgugaagcccggggacauccugcugaucaacuccaccggcaaccucaucgcgccccgcggguacuucaagauccggucgggcaaguccagcaucaugcgcuccgacgccccgaucggcaagugcaacucggagugcaucacgcccaacggguccauccccaacgacaagcccuuccagaacgucaaccggaucaccuacggcgccugcccgcgcuacgugaagcagaacacccugaagcuggccaccgggaugcggaacgugcccgagaagcagacgcgcggcaucuucggggccaucgccggcuucaucgagaacggcugggaggggauggucgacggcugguacggguuccggcaccagaacucggagggcaccgggcaggccgccgaccucaaguccacccaggcggccaucaaccagaucaacggcaagcugaaccgccugaucggcaagaccaacgagaaguuccaccagaucgagaaggaguucagcgagguggaggggcggauccaggaccucgagaaguacguggaggacacgaagaucgaccugugguccuacaacgccgagcugcucgucgcccuggagaaccagcacaccaucgaccugaccgacucggagaugaacaagcuguucgagcgcaccaagaagcagcuccgggagaacgccgaggacaugggcaacgggugcuucaagaucuaccacaagugcgacaacgcgugcaucggcuccauccgcaacgggacguacgaccacgacguguaccgcgacgaggcccugaacaaccgguuccagaucaagggcguggagcucaagucgggcuacaaggacuggauccuguggaucuccuucgccaucagcugcuuccugcucugcgucgcccugcugggguucaucaugugggccugccagaagggcaacauccgcugcaacaucugcaucuga

SEQ ID NO: 2032 - RNA, 1701 nt, Artificial Sequence; identical to SEQ ID NO: 875
  derived and/or modified CDS sequence (AUadapt) from InfluenzaA__ABU92636__HA

SEQ ID NO: 2033 - RNA, 1701 nt, Artificial Sequence
  derived and/or modified CDS sequence (AUadapt) from InfluenzaA__ABU92637__HA
augaagaccaucaucgcccugucguacauccucugccugguguucgcccagaagcugcccggcaacgacaacuccaccgcgacgcucugccuggggcaccacgccgucccgaacggcaccaccgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgucagccugcggucccucguggcgucguccgggacccuggaguucaacaacgagagcuucaacuggaccggcgugacccagaacgggacguccucggccugcaagcgccgguccaacaacucguucuucucccgccugaacuggcucacccaccugaaguucaaguaccccgcccugaacgucaccaugcccaacaacgagaaguucgacaagcucuacaucuggggcgugcaccaccccgggaccgacaacgaccagaucagccuguacgcccaggcguccggccggaucacggugucgaccaagcgcucgcagcagaccgucaucccgaacaucggcucccggccccgcgugcgggacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaacuccgagugcaucacccccaacgggucgauccccaacgacaagccguuccagaacgucaaccgcaucaccuacggcgccugcccccgguacgugaagcagaacacccugaagcucgccacggggaugcgcaacgugcccgagaagcagacccggggcaucuucggggcgaucgccggcuucaucgagaacggcugggaggggauggucgacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcucgauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2034 - RNA, 1701 nt, Artificial Sequence
  derived and/or modified CDS sequence (AUadapt) from InfluenzaA__ABU92639__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacacgaagugggaccuguucguggagcgcuccaaggccuacucgaacugcuaccccuacgacgugccggacuacgcgucccugcggucgcucgucgccuccagcggcacccuggaguucaacaacgaguccuucgacuggaccggggugacccagaacggcacgucguccgccugcaagcgccggucggacaaguccuucuucagccgccugaacuggcucacccaccugaaguacaaguaccccgcccugaacgugaccaugcccaacaacgagaaguucgacaagcucuacaucuggggcguccaccaccccgggaccgacuccgaccagaucucgcuguacgcgcaggccuccgggcggaucacggugagcaccaagcgcucgcagcagaccgugaucccgaacaucggcucccggccccgcguccgggacgugucgucccgcaucagcaucuacuggaccaucgugaagcccggcgacauccugcucaucaacuccacggggaaccugaucgcgccccggggcuacuucaagauccgcucggggaaguccucgaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacucggaggggaccggccaggccgccgaccugaaguccacccaggcggccaucaaccagaucaacgggaagcugaaccggcucaucggcaagacgaacgagaaguuccaccagaucgagaaggaguucucggagguggagggccgcauccaggaccuggagaaguacaucgaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 2035 - RNA, 1701 nt, Artificial Sequence
  derived and/or modified CDS sequence (AUadapt) from InfluenzaA__ABU92640__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgccgcccugcucggcuucaucaugugggcgugccagaaggggaacauccggugcaacaucugcaucuga

SEQ ID NO: 2036 - RNA, 1701 nt, Artificial Sequence
  derived and/or modified CDS sequence (AUadapt) from InfluenzaA__ABU92641__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgcaaguccaacaacucguucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugucgacgaagcggucgcagcagaccgugaucccgaacaucggcucccgcccccggguccgcgacauccccagccggaucuccaucuacuggaccaucgugaagcccggggacauccugcucaucaacucgaccggcaaccugaucgccccgcgcggguacuucaagauccgguccggcaagagcuccaucaugcgcucggacgcccccaucggcaagugcaacuccgagugcaucacgcccaacgggucgauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 2037 - RNA, 1701 nt, Artificial Sequence
  derived and/or modified CDS sequence (AUadapt) from InfluenzaA__ABU92642__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaucguguccaccaagcgcucgcagcagacggugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacccccaacggguccauccccaacgacaagccguuccagaacgugaaccgcaucacguacggcgccugcccccgguacgucaagcagaacacccugaagcucgcgaccgggaugcgcaacgugcccgagaagcagacccggggcaucuucggggccaucgccggcuucaucgagaacggcugggaggggaugguggacggcugguacggguuccgccaccagaacucggagggcaucgggcaggccgccgaccugaaguccacgcaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 2038 - RNA, 1701 nt, Artificial Sequence
  derived and/or modified CDS sequence (AUadapt) from InfluenzaA__ABU92643__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucgacuggaccggggugacccagaacggcaccucguccgccugcaagcgccggucggacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccgggcggaucaccgugagcacgaagcgcucgcagcagaccgugaucccgaacaucggcucccggccccgcguccgggacgugucgucccgcaucagcaucuacuggaccaucgugaagcccggcgacauccugcucaucaacuccaccgggaaccugaucgcgccccggggcuacuucaagauccgcucggggaaguccucgaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggaccggccaggccgccgaccugaaguccacccaggcggccaucaaccagaucaacgggaagcugaaccggcucaucggcaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacaacguguaccgggacgaggcccucaacaaccgcuuccagaucaaggggguggagcucaagucgggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 2039 - RNA, 1701 nt, Artificial Sequence
  derived and/or modified CDS sequence (AUadapt) from InfluenzaA__ABU92645__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucgccuacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggaucggccaggccgcggaccugaaguccacgcaggccgccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacucggagaugaacaagcuguucgagcggaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggaucgagcugaaguccggcuacaaggacuggauccuguggaucuccuucgccaucagcugcuuccuccugugcguggugcugcucggcuucaucaugugggccugccagaaggggaacauccggugcaacaucugcaucuga

SEQ ID NO: 2040 - RNA, 1701 nt, Artificial Sequence
  derived and/or modified CDS sequence (AUadapt) from InfluenzaA__ABU92646__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2041 - RNA, 1701 nt, Artificial Sequence; identical to SEQ ID NO: 318
  derived and/or modified CDS sequence (AUadapt) from InfluenzaA__ABU92647__HA

SEQ ID NO: 2042 - RNA, 1701 nt, Artificial Sequence
  derived and/or modified CDS sequence (AUadapt) from InfluenzaA__ABU92648__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucaacuggaccggggugacccagaacggcaccucguccgccugcaagcgccggucggacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccgggcggaucaccgugagcacgaagcgcucgcagcagaccgugaucccgaacaucggcucccggccccgcguccgggacgugucgucccgcaucagcaucuacuggaccaucgugaagcccggcgacauccugcucaucaacuccaccgggaaccugaucgcgccccggggcuacuucaagauccgcucggggaaguccucgaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggaccggccaggccgccgaccugaaguccacccaggcggccaucaaccagaucaacgggaagcugaaccggcucaucggcaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagucgggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 2043 - RNA, 1701 nt, Artificial Sequence; identical to SEQ ID NO: 318
  derived and/or modified CDS sequence (AUadapt) from InfluenzaA__ABU92649__HA

SEQ ID NO: 2044 - RNA, 1701 nt, Artificial Sequence; identical to SEQ ID NO: 2007
  derived and/or modified CDS sequence (AUadapt) from InfluenzaA__ABU92650__HA

SEQ ID NO: 2045 - RNA, 1701 nt, Artificial Sequence
  derived and/or modified CDS sequence (AUadapt) from InfluenzaA__ABU92651__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucuacaacgaguccuucgacuggaccggggugacccagaacggcaccucguccgccugcaagcgccggagcgacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugucgacgaagcgcucgcagcagaccgugaucccgaacaucggcucccggccccgcguccgggacgugagcucccgcaucucgaucuacuggaccaucgugaagcccggcgacauccugcucaucaacuccaccgggaaccugaucgcgccccggggcuacuucaagauccgcagcgggaaguccucgaucaugcgguccgacgccccgaucggcaagugcaacucggagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagucgggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 2046 - RNA, 1701 nt, Artificial Sequence
  derived and/or modified CDS sequence (AUadapt) from InfluenzaA__ABU92652__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucgacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaucggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 2047 - RNA, 1701 nt, Artificial Sequence; identical to SEQ ID NO: 2007
  derived and/or modified CDS sequence (AUadapt) from InfluenzaA__ABU92653__HA

SEQ ID NO: 2048 - RNA, 1701 nt, Artificial Sequence
  derived and/or modified CDS sequence (AUadapt) from InfluenzaA__ABU92654__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggcaagaucaccgugagcacgaagcggucgcagcagaccgugaucccgaacaucggcucccgcccccggguccgcgacgugcccucgcggaucuccaucuacuggaccaucgugaagcccggggacauccugcucaucaacagcaccggcaaccugaucgccccgcgcggguacuucaagauccgguccggcaagucguccaucaugcgcucggacgcccccaucggcaagugcaacuccgagugcaucacgcccaacgggagcauccugaacgacaagcccuuccagaacgucaaccggaucaccuacggcgccugcccgcgcuacgugaagcagaacacccucaagcuggcgaccgggaugcggaacgugcccgagaagcagacgcgcggcaucuucggggccaucgccggcuucaucgagaacggcugggaggggauggucgacggcugguacggguuccggcaccagaacgccgagggcaccgggcaggccgcggaccugaaguccacccaggccgccaucaaccagaucaacggcaagcucaaccgccugaucggcaagaccaacgagaaguuccaccagaucgagaaggaguucucggagguggaggggcggauccaggaccuggagaaguacguggaggacacgaagaucgaccucugguccuacaacgccgagcugcuggucgcccucgagaaccagcacaccaucgaccugaccgacucggagaugaacaagcuguucgagcgcaccaagaagcagcuccgggagaacgcggaggacaugggcaacgggugcuucaagaucuaccacaagugcgacaacgccugcaucggcuccauccgcaacgggacguacgaccacgacguguaccgcgacgaggcccugaacaaccgguuccagaucaagggcguggagcugaaguccggcuacaaggacuggauccucuggaucuccuucgccaucagcugcuuccugcugugcgucgcccuccugggguucaucaugugggcgugccagaagggcaacauccgcugcaacaucugcaucuga

SEQ ID NO: 2049 - RNA, 1701 nt, Artificial Sequence
  derived and/or modified CDS sequence (AUadapt) from InfluenzaA__ABU92655__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacgugcccagccgcaucuccaucuacuggaccaucgugaagcccggggacauccugcucaucaacucgaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacgccgagggcaccgggcaggccgcggaccugaaguccacccaggccgccaucaaccagaucaacggcaagcugaaccggcucaucggcaagaccaacgagaaguuccaccagaucgagaaggaguucucggagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggcgugccagaagggcaacauccggugcaacaucugcaucuga

SEQ ID NO: 2050 - RNA, 1701 nt, Artificial Sequence; identical to SEQ ID NO: 2007
  derived and/or modified CDS sequence (AUadapt) from InfluenzaA__ABU92656__HA

SEQ ID NO: 2051 - RNA, 1701 nt, Artificial Sequence; identical to SEQ ID NO: 878
  derived and/or modified CDS sequence (AUadapt) from InfluenzaA__ABU92657__HA

SEQ ID NO: 2052 - RNA, 1701 nt, Artificial Sequence; identical to SEQ ID NO: 2007
  derived and/or modified CDS sequence (AUadapt) from InfluenzaA__ABU92658__HA

SEQ ID NO: 2053 - RNA, 1701 nt, Artificial Sequence; identical to SEQ ID NO: 878
  derived and/or modified CDS sequence (AUadapt) from InfluenzaA__ABU92659__HA

SEQ ID NO: 2054 - RNA, 1701 nt, Artificial Sequence; identical to SEQ ID NO: 2007
  derived and/or modified CDS sequence (AUadapt) from InfluenzaA__ABU92660__HA

SEQ ID NO: 2055 - RNA, 1701 nt, Artificial Sequence
  derived and/or modified CDS sequence (AUadapt) from InfluenzaA__ABU92661__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucgacuggaccggggugacccagaacggcaccucguccgccugcaagcgccggucggacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccgggcggaucaccgugagcacgaagcgcucgcagcagaccgugaucccgaacaucggcucccggccccgcguccgggacgugucgucccgcaucagcaucuacuggaccaucgugaagcccggcgacauccugcucaucaacuccaccgggaaccugaucgcgccccggggcuacuucaagauccgcucggggaaguccucgaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggaccggccaggccgccgaccugaaguccacccaggcggccaucaaccagaucaacgggaagcugaaccggcucaucggcaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcuggagucgggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 2056 - RNA, 1701 nt, Artificial Sequence; identical to SEQ ID NO: 318
  derived and/or modified CDS sequence (AUadapt) from InfluenzaA__ABU92662__HA

SEQ ID NO: 2057 - RNA, 1701 nt, Artificial Sequence; identical to SEQ ID NO: 2007
  derived and/or modified CDS sequence (AUadapt) from InfluenzaA__ABU92663__HA

SEQ ID NO: 2058 - RNA, 1701 nt, Artificial Sequence; identical to SEQ ID NO: 2007
  derived and/or modified CDS sequence (AUadapt) from InfluenzaA__ABU92664__HA

SEQ ID NO: 2059 - RNA, 1701 nt, Artificial Sequence
  derived and/or modified CDS sequence (AUadapt) from InfluenzaA__ABU92665__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucucgcuguacgcgcaggccuccggccggaucaccgugagcacgaagcgcucgcagcagaccgugaucccgaacaucggcucccggccccgcguccgggacgugcccucgcgcaucuccaucuacuggaccaucgugaagcccggggacauccugcucaucaacagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugacccagaacacccugaagcucgcgacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2060 - RNA, 1701 nt, Artificial Sequence; identical to SEQ ID NO: 2007
  derived and/or modified CDS sequence (AUadapt) from InfluenzaA__ABU92666__HA

SEQ ID NO: 2061 - RNA, 1701 nt, Artificial Sequence; identical to SEQ ID NO: 317
  derived and/or modified CDS sequence (AUadapt) from InfluenzaA__ABU92667__HA

SEQ ID NO: 2062 - RNA, 1701 nt, Artificial Sequence; identical to SEQ ID NO: 317
  derived and/or modified CDS sequence (AUadapt) from InfluenzaA__ABU92668__HA

SEQ ID NO: 2063 - RNA, 1701 nt, Artificial Sequence
  derived and/or modified CDS sequence (AUadapt) from InfluenzaA__ABU92669__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggucgacggccuacuccaacugcuaccccuacgacgucccggacuacgcgagccuccgcucccugguggccucguccggcacccuggaguucaacaacgagagcuucaacuggaccggcguggcccagaacgggaccuccucggccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccucgaccgacuccgaccagaucagccuguacgcccaggccucggggcgcgugaccgucuccaccaagcggagccagcagacggugaucccgaacaucggcucccgccccugggugcgcggggucucgucccggaucagcaucuacuggaccaucgugaagcccggcgacauccuccugaucaacuccaccggcaaccugaucgcgccccggggguacuucaagauccgcaacggcaagucguccaucaugcggagcaacgccccgaucgggaagugcaacuccgagugcaucacccccaacggcucgauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgcggaccugaaguccacccaggccgccaucaaccagaucaacggcaagcucaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggucgauccggaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 2064 - RNA, 1701 nt, Artificial Sequence; identical to SEQ ID NO: 317
  derived and/or modified CDS sequence (AUadapt) from InfluenzaA__ABU92670__HA

SEQ ID NO: 2065 - RNA, 1701 nt, Artificial Sequence
  derived and/or modified CDS sequence (AUadapt) from InfluenzaA__ABU92671__HA
augaagaccaucaucgcccugucgcacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagucguccagcaccggccgcaucugcgacaucccccaccagauccuggacggggagaacugcacccugaucgacgcccuccugggcgacccccacugcgacggguuccagaacaaggagugggaccuguucguggagcgguccacggccuacucgaacugcuaccccuacgacgucccggacuacgcgucccuccgcagccugguggccuccucgggcacccuggaguucaacaacgaguccuucaacuggaccggcguggcccagaacgggaccagcuccgccugcaagcggcgcucgaucaaguccuucuucagccggcucaacuggcugcaccagcugaaguacaaguaccccgcgcucaacgucacgaugcccaacaacgagaaguucgacaagcuguacaucuggggcgugcaccaccccuccaccgacucggaccagaucucccuguacgcccaggccccggggcgcgugaccgucagcaccaagcggucgcagcagacggugauccccaacaucggcucccgccccugggugcgcggggucucgucccggaucagcaucuacuggaccaucgugaagcccggcgacauccuccugaucaacuccaccggcaaccugaucgccccgcggggguacuucaagauccgcucgggcaaguccagcaucaugcgguccaacgcccccaucgggaagugcaacucggagugcaucacccccaacggcuccauccccaacgacaagccguuccagaacgugaaccgcaucacguacggcgcgugcccccgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucucggaggccgaggggcgcauccaggaccuggagaaguacgucgaggacaccaagaucgaccucugguccuacaacgccgagcugcugguggcgcucgagaaccagcacacgaucgaccugaccgacagcgagaugaacaagcuguucgagcggacccgcaagcagcuccgcgagaacgccgaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcucaagucgggcuacaaggacuggauccuguggaucuccuucgccaucagcugcuuccugcugugcgugguccuccugggguucaucaugugggcgugccagaagggcaacauccgcugcaacaucugcaucuga

SEQ ID NO: 2066 - RNA, 1701 nt, Artificial Sequence; identical to SEQ ID NO: 317
  derived and/or modified CDS sequence (AUadapt) from InfluenzaA__ABU92672__HA

SEQ ID NO: 2067 - RNA, 1701 nt, Artificial Sequence; identical to SEQ ID NO: 317
  derived and/or modified CDS sequence (AUadapt) from InfluenzaA__ABU92673__HA

SEQ ID NO: 2068 - RNA, 1701 nt, Artificial Sequence
  derived and/or modified CDS sequence (AUadapt) from InfluenzaA__ABU92674__HA
augaagaccaucaucgcccugucguacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccucgaccggccgcaucugcgacagcccccaccagauccuggacggggagaacugcacccugaucgacgcccuccugggcgacccccacugcgacggguuccagaacaaggagugggaccuguucguggagcggcgcacggccuacucgaacugcuaccccuacgacgucccggacuacgcgucccuccggagccugguggccuccucgggcacccuggaguucaacaacgaguccuucaacuggaccggcguggcccagaacgggaccagcuccgccugcaagcgccggucgaucaaguccuucuucagccgccucaacuggcugcaccagcugaaguacaaguaccccgcgcucaacgucacgaugcccaacaacgagaaguucgacaagcuguacaucuggggcgugcaccaccccuccaccgacucggaccagaucucccuguacgcccaggccagcgggcgggugaccgucucgaccaagcgcucccagcagacggugaucccgaacaucggcagccggcccugggugcgcggggucuccucgcggaucuccaucuacuggaccaucgugaagcccggcgacauccuccugaucaacagcaccggcaaccugaucgcgccccgcggguacuucaagauccgguccggcaagucguccaucaugcgcagcaacgccccgaucgggaagugcaacuccgagugcaucacccccaacggcucgauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacuccgagggcacggggcaggccgcggaccugaaguccacccaggccgccaucaaccagaucaacggcaagcucaaccgccugaucgagaagaccaacgagaaguuccaccagaucgagaaggaguucuccgaggucgaggggcggauccaggaccuggagaaguacguggaggacaccaagaucgaccucuggagcuacaacgccgagcugcugguggcccucgagaaccagcacacgaucgaccugaccgacuccgagaugaacaagcuguucgagcgcacccgcaagcagcuccgggagaacgcggaggacaugggcaacggcugcuucaagaucuaccacaagugcgacaacgccugcaucgggucgauccgcaacggcaccuacgaccacgacgucuaccgggacgaggcccugaacaaccgcuuccagaucaaggggguggagcugaaguccggcuacaaggacuggauccucuggaucagcuucgccaucagcugcuuccugcugugcgucgugcuccugggguucaucaugugggccugccagaagggcaacauccggugcaacaucugcaucuga

SEQ ID NO: 2069 - RNA, 1701 nt, Artificial Sequence
  derived and/or modified CDS sequence (AUadapt) from InfluenzaA__ABU92675__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccucgggccggaucaccgucagcacgaagcgcucccagcagaccgugaucccgaacaucggcucgcggccccgcgugcgggacauccccucccgcaucagcaucuacuggaccaucgucaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaugggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2070 - RNA, 1701 nt, Artificial Sequence; identical to SEQ ID NO: 878
  derived and/or modified CDS sequence (AUadapt) from InfluenzaA__ABU92676__HA

SEQ ID NO: 2071 - RNA, 1701 nt, Artificial Sequence; identical to SEQ ID NO: 1998
  derived and/or modified CDS sequence (AUadapt) from InfluenzaA__ABU92677__HA

SEQ ID NO: 2072 - RNA, 1701 nt, Artificial Sequence
  derived and/or modified CDS sequence (AUadapt) from InfluenzaA__ABU92678__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggccugcagaacaagaagugggaccuguucguggagcgcucgaaggccuacuccaacugcuaccccuacgacgugccggacuacgcgagccuccggucccugaucgccucguccgggacgcuggaguucaacaacgagucguucaacuggaccggcgucacccagaacgggaccuccagcgccugcaagcgccgguccaacaacucguucuucucccgccucaacuggcugacgcaccugaaguucaaguaccccgcccucaacgugaccaugcccaacaacgaggaguucgacaagcuguacaucuggggcgugcaccaccccgggaccgacaacgaccagaucucgcuguacgcgcaggccuccggccggaucaccgucagcacgaagcgcucgcagcagaccgugaucccgaacaucggcucccggccccgcgugcgggacauccccucgcgcaucuccaucuacuggaccaucgucaagcccggggacauccuccugaucaacagcaccggcaaccugaucgccccgcggggguacuucaagauccgcuccggcaagucguccaucaugcggucggacgcccccaucggcaacugcaacuccgagugcaucacgcccaacgggagcauccccaacgacaagccguuccagaacgugaaccgcaucaccuacggcgccugcccccgguacgugaagcagaacacccucaagcuggcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcucaaccggcugaucggcaagaccaacgagaaguuccaccagaucgagaaggaguucuccgagguggaggggcgcauccaggaccuggagaaguacgucgaggacaccaagaucgaccucuggucguacaacgccgagcugcugguggcccucgagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggaccuacgaccacgacguguaccgggacgaggcccugaacaaccgcuuccagaucaagggcgucgagcugaaguccggcuacaaggacuggauccucuggaucagcuucgccaucuccugcuuccugcugugcguggcccuccugggguucaucaugugggccugccagaagggcaacauccggugcaacaucugcaucuga

SEQ ID NO: 2073 - RNA, 1701 nt, Artificial Sequence
  derived and/or modified CDS sequence (AUadapt) from InfluenzaA__ABU92680__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 2074 - RNA, 1701 nt, Artificial Sequence; identical to SEQ ID NO: 2002
  derived and/or modified CDS sequence (AUadapt) from InfluenzaA__ABU92681__HA

SEQ ID NO: 2075 - RNA, 1701 nt, Artificial Sequence; identical to SEQ ID NO: 318
  derived and/or modified CDS sequence (AUadapt) from InfluenzaA__ABU92682__HA

SEQ ID NO: 2076 - RNA, 1701 nt, Artificial Sequence; identical to SEQ ID NO: 2007
  derived and/or modified CDS sequence (AUadapt) from InfluenzaA__ABU92683__HA

SEQ ID NO: 2077 - RNA, 1701 nt, Artificial Sequence
  derived and/or modified CDS sequence (AUadapt) from InfluenzaA__ABU92684__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucaucgagcgcuccaaggccuacucgaacugcuaccccuacgacgugccggacuacgcgucccugcggucgcucguggccuccagcgggacgcuggaguucaacaacgaguccuucgacuggaccggcgucacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcgugcaccaccccgggaccgacuccgaccagaucucgcuguacgcgcaggccccgggccggaucaccgucuccacgaagcgcucgcagcagaccgugauccccaacaucggcagccggccccgcgugcgggacgucuccucgcgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 2078 - RNA, 1701 nt, Artificial Sequence
  derived and/or modified CDS sequence (AUadapt) from InfluenzaA__ABU92685__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccucgaucaugaaguccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacucggagggcaccgggcaggccgccgaccugaaguccacccaggcggccaucaaccagaucaacggcaagcugaaccgccucaucggcaagaccaacgagaaguuccaccagaucgagaaggaguucucggagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcguggagcucaagucgggcuacaaggacuggauccuguggaucuccuucgccaucagcugcuuccugcugugcgucgcccugcucggguucaucaugugggccugccagaagggcaacauccgcugcaacaucugcaucuga

SEQ ID NO: 2079 - RNA, 1701 nt, Artificial Sequence; identical to SEQ ID NO: 2007
  derived and/or modified CDS sequence (AUadapt) from InfluenzaA__ABU92686__HA

SEQ ID NO: 2080 - RNA, 1701 nt, Artificial Sequence; identical to SEQ ID NO: 2007
  derived and/or modified CDS sequence (AUadapt) from InfluenzaA__ABU92687__HA

SEQ ID NO: 2081 - RNA, 1701 nt, Artificial Sequence; identical to SEQ ID NO: 2040
  derived and/or modified CDS sequence (AUadapt) from InfluenzaA__ABU92688__HA

SEQ ID NO: 2082 - RNA, 1701 nt, Artificial Sequence; identical to SEQ ID NO: 2007
  derived and/or modified CDS sequence (AUadapt) from InfluenzaA__ABU92689__HA

SEQ ID NO: 2083 - RNA, 1701 nt, Artificial Sequence
  derived and/or modified CDS sequence (AUadapt) from InfluenzaA__ABU92691__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucgacuggaccggcgugacccagaacgggaccucguccgccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcucccggccccgcguccgggacgugucgucccgcaucagcaucuacuggaccaucgugaagcccggggacauccugcucaucaacuccaccggcaaccugaucgcgccccggggguacuucaagauccgcucgggcaaguccucggucaugcgguccgacgccccgaucggcaagugcaacagcgagugcaucacgcccaacggguccauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucucggagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaucggcaacgggugcuucaagaucuaccacaagugcgacaacgcgugcaucggcuccauccgcaacgggacguacgaccacaacguguaccgggacgaggcccucaacaaccgcuuccagaucaagggcgucgagcucaagucgggcuacaaggacuggauccuguggaucuccuucgccaucagcugcuuccugcugugcguggcccugcucggguucaucaugugggccugccagaagggcaacauccggugcaacaucugcaucuga

SEQ ID NO: 2084 - RNA, 1701 nt, Artificial Sequence; identical to SEQ ID NO: 935
  derived and/or modified CDS sequence (AUadapt) from InfluenzaA__ABU92692__HA

SEQ ID NO: 2085 - RNA, 1701 nt, Artificial Sequence
  derived and/or modified CDS sequence (AUadapt) from InfluenzaA__ABU92693__HA
augaaggccaucaucgcccugucguacauccucugccugguguucgcgcagaagcugcccggcaacgacaacuccaccgccacccucugccuggggcaccacgccgucccgaacggcacgaucgugaagaccaucaccaacgaccagaucgaggugaccaacgccacggagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggcguacucgaacugcuaccccuacgacgugccggacuacgccucccugcggucgcucgucgccuccagcggcacccuggaguucaacaacgaguccuucgacuggacgggggugacccagaacggcaccucguccgccugcaagcgccggucggacaaguccuucuucagccgccugaacuggcucacccaccugaaguacaaguaccccgcgcugaacgugacgaugcccaacaacgagaaguucgacaagcucuacaucuggggcguccaccaccccgggaccgacuccgaccagaucucgcuguacgcccaggccuccgggcggaucaccgugagcaccaagcgcucgcagcagacggugaucccgaacaucggcucccggccccgcguccgggacgugucgucccgcaucagcaucuacuggaccaucgugaagcccggcgacauccugcucaucaacuccaccgggaaccugaucgcgccccggggcuacuucaagauccgcucggggaaguccucgaucaugcgguccgacgccccgaucggcaagugcaacagcgagugcaucacccccaacggcuccauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggacgggccaggccgcggaccugaaguccacccaggccgccaucaaccagaucaacgggaagcugaaccggcucaucggcaagaccaacgagaaguuccaccagaucgagaaggaguucucggagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcucaagucgggcuacaaggacuggauccuguggaucuccuucgccaucagcugcuuccugcugugcgucgcccugcucggcuucaucaugugggcgugccagaaggggaacauccggugcaacaucugcaucuga

SEQ ID NO: 2086 - RNA, 1701 nt, Artificial Sequence
  derived and/or modified CDS sequence (AUadapt) from InfluenzaA__ABU92694__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugucgacgaagcgcucgcagcagaccgugaucccgaacaucggcucccggccccgcguccgggacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagguggaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2087 - RNA, 1701 nt, Artificial Sequence; identical to SEQ ID NO: 1998
  derived and/or modified CDS sequence (AUadapt) from InfluenzaA__ABU92695__HA

SEQ ID NO: 2088 - RNA, 1701 nt, Artificial Sequence
  derived and/or modified CDS sequence (AUadapt) from InfluenzaA__ABU92696__HA
augaagaccaucaucgcccugggcuacauccucugccugguguucgcccagaagcugcccgggaacgacaacucgaccgcgacgcucugccugggccaccacgccgucccgaacgggaccaucgugaagaccaucaccaacgaccagaucgaggugacgaacgccaccgagcugguccaguccucguccaccggcgggaucugcgacagcccccaccagauccucgacggcgagaacugcacccugaucgacgcccugcucggcgacccccagugcgacggguuccagaacaagaagugggaccuguucguggagcgcuccaaggccuacucgaacugcuaccccuacgacgugccggacuacgcgucccugcggucgcucaucgccuccagcggcacgcuggaguucaacaacgaguccuucaacuggaccggggucacccagaacggcaccucguccgccugcaagcgccggagcaacuccucguucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucucgcuguacgcgcaggccuccggccggaucaccgucagcacgaagcgcucgcagcagaccgugaucccgaacaucgggucccggccccgcgugcgggacauccccucgcgcaucuccaucuacuggaccaucgucaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggcuucaucgagaacgggugggagggcaugguggacgggugguacggcuuccgccaccagaacuccgaggggaucggccaggccgccgaccucaagucgacccaggcggccaucgaccagaucaacggcaagcugaaccggcugaucgggaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcaccuacgaccacgacguguaccgggacgaggcccucaacaaccgcuuccagaucaagggcgucgagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 2089 - RNA, 1701 nt, Artificial Sequence; identical to SEQ ID NO: 878
  derived and/or modified CDS sequence (AUadapt) from InfluenzaA__ABU92697__HA

SEQ ID NO: 2090 - RNA, 1701 nt, Artificial Sequence; identical to SEQ ID NO: 488
  derived and/or modified CDS sequence (AUadapt) from InfluenzaA__ABU92698__HA

SEQ ID NO: 2091 - RNA, 1701 nt, Artificial Sequence
  derived and/or modified CDS sequence (AUadapt) from InfluenzaA__ABU92699__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacugggccggcgugacccagaacgggaccuccucggccugcaagcgccgguccaacaacagcuucuucucccgccugaacuggcucacccaccugaaguucaaguaccccgcgcugaacgugacgaugcccaacaacgagaaguucgacaagcucuacaucuggggcguccaccaccccgggaccgacaacgaccagaucuuccuguacgcccaggccucgggccggaucaccguguccaccaagcgcagccagcagacggugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacccccaacggguccauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacucggagggcaucgggcaggccgcggaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgggagaacgcggaggacaugggcaacgggugcuucaagaucuaccacaagugcgacaacgccugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggcgugccagaagggcaacauccgcugcaacaucugcaucuga

SEQ ID NO: 2092 - RNA, 1701 nt, Artificial Sequence
  derived and/or modified CDS sequence (AUadapt) from InfluenzaA__ABU92700__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgggaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagcgguucgacaagcucuacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2093 - RNA, 1701 nt, Artificial Sequence
  derived and/or modified CDS sequence (AUadapt) from InfluenzaA__ABU92701__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgggaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcaagcgccgguccaacaacucguucuucucccgccugaacuggcucacgcaccugaaguucaaguaccccgcccugaacgugaccaugcccaacaacgagcgguucgacaagcucuacaucuggggcguccaccaccccgggaccgacaacgaccagaucuuccuguacgcgcaggccagcgggcgcaucaccguguccacgaagcggucgcagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgccugcagaucaaggggguggagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 2094 - RNA, 1701 nt, Artificial Sequence; identical to SEQ ID NO: 857
  derived and/or modified CDS sequence (AUadapt) from InfluenzaA__ABU92702__HA

SEQ ID NO: 2095 - RNA, 1701 nt, Artificial Sequence; identical to SEQ ID NO: 2073
  derived and/or modified CDS sequence (AUadapt) from InfluenzaA__ABU92703__HA

SEQ ID NO: 2096 - RNA, 1701 nt, Artificial Sequence
  derived and/or modified CDS sequence (AUadapt) from InfluenzaA__ABU92704__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcaacaaggccuacagcaacugcuaccccuacgacgugccggacuacgcgucccugcggucgcucgucgccuccucggggacgcuggaguucaacaacgaguccuucaacuggaccggcgugacccagaacgggaccagcuccgccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugucgacgaagcgcucccagcagaccgugaucccgaacaucggcucgcggccccgcguccggaacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacaugggcaacgggugcuucaagaucuaccacaagugcgacaacgcgugcaucggcucgauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 2097 - RNA, 1701 nt, Artificial Sequence
  derived and/or modified CDS sequence (AUadapt) from InfluenzaA__ABU92705__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacaacucguucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucucgcuguacgcgcaggccccgggccggaucaccgucuccacgaagcgcagccagcagaccgugauccccaacaucggcucgcggccccgcgugcgggacauccccucccgcaucucgaucuacuggaccaucgucaagccgggggacauccugcucaucaacuccaccggcaaccugaucgcgccccggggguacuucaagauccgcagcggcaaguccucgaucaugcgguccgacgcccccaucggcaagugcaagagcgagugcaucacgcccaacggguccaucccgaacgacaagcccuuccagaacgugaaccgcaucaccuacggcgccugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucucggagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccggaucaagucggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 2098 - RNA, 1701 nt, Artificial Sequence; identical to SEQ ID NO: 318
  derived and/or modified CDS sequence (AUadapt) from InfluenzaA__ABU92706__HA

SEQ ID NO: 2099 - RNA, 1701 nt, Artificial Sequence; identical to SEQ ID NO: 2007
  derived and/or modified CDS sequence (AUadapt) from InfluenzaA__ABU92707__HA

SEQ ID NO: 2100 - RNA, 1701 nt, Artificial Sequence; identical to SEQ ID NO: 2007
  derived and/or modified CDS sequence (AUadapt) from InfluenzaA__ABU92708__HA

SEQ ID NO: 2101 - RNA, 1701 nt, Artificial Sequence
  derived and/or modified CDS sequence (AUadapt) from InfluenzaA__ABU92709__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacugggccggcgugacccagaacgggaccuccagcgccugcaagcgccgguccaacaagucguucuucucccgccugaacuggcucacccaccugaaguacaaguaccccgcgcugaacgugacgaugcccaacaacgagaaguucgacaagcucuacaucuggggcguccaccaccccgggaccgacucggaccagaucucccuguacgcccaggccagcggccggaucaccgugucgaccaagcgcucccagcagacggugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacccccaacgggucgauccccaacgacaagcccuuccagaacgucaaccgcaucacguacggcgccugcccgcgguacgugaagcagaacacccugaagcucgccaccgggaugcgcaacgugcccgagaagcagacccggggcaucuucggggccaucgccggcuucaucgagaacggcugggaggggauggucgacggcugguacggguuccgccaccagaacuccgagggcacggggcaggccgcggaccugaaguccacccaggccgccaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacacgaucgaccucaccgacuccgagaugaacaagcuguucgagcggaccaagaagcagcugcgcgagaacgcggaggacaugggcaacgggugcuucaagaucuaccacaagugcgacaacgccugcaucgagagcauccgcaacggcaccuacgaccacgacguguaccgggacgaggcccucaacaaccgcuuccagaucaaggggguggagcugaaguccggcuacaaggacuggauccuguggaucucguucgccaucagcugcuuccuccugugcgucgcccugcucggcuucaucaugugggcgugccagaaggggaacauccggugcaacaucugcaucuga

SEQ ID NO: 2102 - RNA, 1701 nt, Artificial Sequence; identical to SEQ ID NO: 296
  derived and/or modified CDS sequence (AUadapt) from InfluenzaA__ABU92710__HA

SEQ ID NO: 2103 - RNA, 1701 nt, Artificial Sequence; identical to SEQ ID NO: 318
  derived and/or modified CDS sequence (AUadapt) from InfluenzaA__ABU92711__HA

SEQ ID NO: 2104 - RNA, 1701 nt, Artificial Sequence; identical to SEQ ID NO: 318
  derived and/or modified CDS sequence (AUadapt) from InfluenzaA__ABU92712__HA

SEQ ID NO: 2105 - RNA, 1701 nt, Artificial Sequence; identical to SEQ ID NO: 2007
  derived and/or modified CDS sequence (AUadapt) from InfluenzaA__ABU92713__HA

SEQ ID NO: 2106 - RNA, 1701 nt, Artificial Sequence; identical to SEQ ID NO: 2007
  derived and/or modified CDS sequence (AUadapt) from InfluenzaA__ABU92714__HA

SEQ ID NO: 2107 - RNA, 1701 nt, Artificial Sequence
  derived and/or modified CDS sequence (AUadapt) from InfluenzaA__ABU92715__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucgacuggaccggggugacccagaacggcaccucguccgccugcaagcgccggucgaacaaguccuucuucagccgccugaacuggcucacgcaccugaaguacaaguaccccgcccugaacgugaccaugcccaacaacgagaaguucgagaagcucuacaucuggggcguccaccaccccgggaccgacuccgaccagaucaaccuguacgcgcaggccucggggcggaucaccguguccacgaagcgcucgcagcagaccgugaucccgaacaucggcagccggccccgcguccgggacguguccucgcgcaucuccaucuacuggaccaucgugaagcccggcgacauccugcucaucaacucgaccgggaaccugaucgcgccccggggcuacuucaagauccgcuccggcaagagcuccaucaugcggucggacgccccgaucgggaagugcaacuccgagugcaucacgcccaacggcucgauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcacguacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 2108 - RNA, 1701 nt, Artificial Sequence; identical to SEQ ID NO: 2007
  derived and/or modified CDS sequence (AUadapt) from InfluenzaA__ABU92716__HA

SEQ ID NO: 2109 - RNA, 1701 nt, Artificial Sequence; identical to SEQ ID NO: 2007
  derived and/or modified CDS sequence (AUadapt) from InfluenzaA__ABU92717__HA

SEQ ID NO: 2110 - RNA, 1701 nt, Artificial Sequence; identical to SEQ ID NO: 318
  derived and/or modified CDS sequence (AUadapt) from InfluenzaA__ABU92718__HA

SEQ ID NO: 2111 - RNA, 1701 nt, Artificial Sequence; identical to SEQ ID NO: 318
  derived and/or modified CDS sequence (AUadapt) from InfluenzaA__ABU92719__HA

SEQ ID NO: 2112 - RNA, 1701 nt, Artificial Sequence
  derived and/or modified CDS sequence (AUadapt) from InfluenzaA__ABU92720__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacuccucgcugcggucccucgucgcgagcuccggcacgcuggaguucaacaacgagucguucgacuggaccggggugacccagaacggcaccuccagcgccugcaagcgccgguccgacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcccaggcgagcgggcggaucaccgugucgacgaagcgcucccagcagaccgugaucccgaacaucggcagccggccccgcguccgggacguguccucgcgcaucuccaucuacuggaccaucgugaagcccggcgacauccugcucaucaacucgaccgggaaccugaucgcgccccggggcuacuucaagauccgcuccggcaagagcuccaucaugcggucggacgccccgaucgggaagugcaacuccgagugcaucacgcccaacggcagcauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagucgacccaggccgcgaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcacguacgaccacgacguguaccgggacgaggcgcucaacaaccgcuuccagaucaaggggguggagcugaaguccggcuacaaggacuggauccuguggaucucguucgccaucagcugcuuccuccugugcgucgcccugcucggcuucaucaugugggccugccagaaggggaacauccggugcaacaucugcaucuga

SEQ ID NO: 2113 - RNA, 1701 nt, Artificial Sequence
  derived and/or modified CDS sequence (AUadapt) from InfluenzaA__ABU92721__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccucgggcacgcuggaguucaacaacgaguccuucgacuggaccggggugacccagaacggcaccagcuccgccugcaagcgccggucggacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugucgacgaagcgcucgcagcagaccgugaccccgaacaucggcucccggccccgcguccgggacgugagcucccgcaucucgaucuacuggaccaucgugaagcccggcgacauccugcucaucaacuccacggggaaccugaucgcgccccggggcuacuucaagauccgcucggggaaguccagcaucaugcgguccgacgccccgaucggcaagugcaacucggagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacucggaggggaccggccaggccgccgaccugaaguccacccaggcggccaucaaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagcggacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcucaagucgggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 2114 - RNA, 1701 nt, Artificial Sequence; identical to SEQ ID NO: 1998
  derived and/or modified CDS sequence (AUadapt) from InfluenzaA__ABU92722__HA

SEQ ID NO: 2115 - RNA, 1701 nt, Artificial Sequence; identical to SEQ ID NO: 318
  derived and/or modified CDS sequence (AUadapt) from InfluenzaA__ABU92723__HA

SEQ ID NO: 2116 - RNA, 1701 nt, Artificial Sequence; identical to SEQ ID NO: 2101
  derived and/or modified CDS sequence (AUadapt) from InfluenzaA__ABU92724__HA

SEQ ID NO: 2117 - RNA, 1701 nt, Artificial Sequence
  derived and/or modified CDS sequence (AUadapt) from InfluenzaA__ABU92725__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacagcgaccagaucaaccuguacgcgcaggccuccggccggaucaccgugucgacgaagcgcucgcagcagaccgugaucccgaacaucggcucccggccccgcguccgggacgugcccagccgcaucuccaucuacuggaccaucgugaagcccggggaccugcuccugaucaacucgaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccucaagcuggcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcucaaccggcugaucggcaagaccaacgagaaguuccaccagaucgagaaggaguucuccgagguggaggggcgcauccaggaccuggagaaguacguggaggacacgaagaucgaccucuggucguacaacgccgagcugcuggucgcccucgagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcucgauccgcaacgggacguacgaccacgacguguaccgggacgaggcccugaacaaccgcuuccagaucaagggcguggagcugaaguccggcuacaaggacuggauccucuggaucagcuucgccaucuccugcuuccugcugugcgucgcccuccugggguucaucaugugggccugccagaagggcaacauccggugcaacaucugcaucuga

SEQ ID NO: 2118 - RNA, 1701 nt, Artificial Sequence; identical to SEQ ID NO: 2101
  derived and/or modified CDS sequence (AUadapt) from InfluenzaA__ABU92726__HA

SEQ ID NO: 2119 - RNA, 1701 nt, Artificial Sequence
  derived and/or modified CDS sequence (AUadapt) from InfluenzaA__ABU92727__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggacuucgacaagcucuacaucuggggcgugcaccaccccgggaccgacaacgaccagaucucccuguacgcgcaggccucgggccggaucaccgucagcacgaagcgcucccagcagaccgugaucccgaacaucggcucgcggccccgcgugcgggacauccccucccgcaucagcaucuacuggaccaucgucaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2120 - RNA, 1701 nt, Artificial Sequence
  derived and/or modified CDS sequence (AUadapt) from InfluenzaA__ABU92728__HA
augaagaccaucaucgcccugucguacauccucugccagguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaucucguccaccggggagaucugcgacucgccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggucgcuggucgccuccucgggcacgcucgaguucaacaacgaguccuucgacuggaccggggugacccagaacggcaccagcuccgccugcaagcgccggucggacaaguccuucuucucgcgccugaacuggcugacgcaccucaaguacaaguaccccgcccugaacgugaccaugcccaacaacgagaaguucgacaagcuguacaucuggggcguccaccaccccgggaccgacaacgaccagaucucccucuacgcgcaggccucggggcggaucaccguguccacgaagcgcagccagcagaccgugaucccgaacaucggcucgcggccccgcguccgggacguguccucgcgcaucuccaucuacuggaccaucgugaagcccggcgacauccugcugaucaacagcaccgggaaccucaucgcgccccggggcuacuucaagauccgcuccggcaagucguccaucaugcggucggacgccccgaucgggaagugcaacuccgagugcaucacgcccaacggcucgauccccaacgacaagcccuuccagaacgucaaccgcaucaccuacggggccugcccgcgguacgugaagcagaacacccugaagcuggccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccucgagaaguacguggaggacacgaagaucgaccuguggucguacaacgccgagcugcucgucgcccuggagaaccagcacaccaucgaccugaccgacuccgagaugaacaagcuguucgagcggaccaagaagcagcuccgcgagaacgccgaggacauggggaacggcugcuucaagaucuaccacaagugcgacaacgcgugcaucgggucgauccgcaacggcacguacgaccacgacguguaccgggacgaggcccugaacaaccgcuuccagaucaaggggguggagcucaaguccggcuacaaggacuggauccuguggaucagcuucgccaucuccugcuuccugcucugcgucgcccugcugggcuucaucaugugggccugccagaaggggaacauccggugcaacaucugcaucuga

SEQ ID NO: 2121 - RNA, 1701 nt, Artificial Sequence; identical to SEQ ID NO: 2120
  derived and/or modified CDS sequence (AUadapt) from InfluenzaA__ABU92729__HA

SEQ ID NO: 2122 - RNA, 1701 nt, Artificial Sequence; identical to SEQ ID NO: 1998
  derived and/or modified CDS sequence (AUadapt) from InfluenzaA__ABU92730__HA

SEQ ID NO: 2123 - RNA, 1701 nt, Artificial Sequence
  derived and/or modified CDS sequence (AUadapt) from InfluenzaA__ABU92731__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccagcuccgggacgcuggaguucaacaacgagucguucaacuggaccggcgucacccagaacgggaccuccagcgccugcaagcgccgguccaacucguccuucuucagccgccugaacuggcucacgcaccugaaguucaaguaccccgcccugaacgugaccaugcccaacaacgaggaguucgacaagcucuacguguggggcguccaccaccccgggaccuacaacgaccagaucucccuguacgcgcaggccucgggccggaucaccgugucgacgaagcgcucccagcagaccgugaucccgaacaucggcagccggccccgcguccgggacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 2124 - RNA, 1701 nt, Artificial Sequence
  derived and/or modified CDS sequence (AUadapt) from InfluenzaA__ABU92732__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacagcuccuucuucucgcgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucucgacgaagcgcucccagcagaccgugaucccgaacaucggcagccggccccgcgugcgggacauccccucccgcaucucgaucuacuggaccaucgucaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggugcugcucggguucaucaugugggccugccagaagggcaacauccggugcaacaucugcaucuga

SEQ ID NO: 2125 - RNA, 1701 nt, Artificial Sequence
  derived and/or modified CDS sequence (AUadapt) from InfluenzaA__ABU92733__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucaucgagcgcucgaaggccuacuccaacugcuaccccuacgacgugccggacuacgcgagccugcggucccucguggccucguccgggacgcuggaguucaacaacgagagcuucaacuggaccggcgucacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucucgacgaagcgcucgcagcagaccgugaucccgaacaucggcucccggccccgcgugcgggacauccccagccgcaucuccaucuacuggaccaucgucaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagguggaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacaaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 2126 - RNA, 1701 nt, Artificial Sequence; identical to SEQ ID NO: 1998
  derived and/or modified CDS sequence (AUadapt) from InfluenzaA__ABU92734__HA

SEQ ID NO: 2127 - RNA, 1701 nt, Artificial Sequence
  derived and/or modified CDS sequence (AUadapt) from InfluenzaA__ABU92735__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgggucgccccaccagauccucgacggcgagaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccccggcccggaucaccguguccacgaagcgcucgcagcagaccgugauccccaacaucggcucgcggccccgcguccgggacauccccucccgcaucagcaucuacuggaccaucgugaagccgggggacauccugcucaucaacuccaccggcaaccugaucgcgccccggggguacuucaagauccugucgggcaaguccagcaucaugcgcuccgacgcccccaucggcaagugcaacucggagugcaucacgcccaacggguccaucccgaacgacaagcccuuccagaacgugaaccggaucaccuacggcgccugcccccgcuacgucaagcagaacacccucaagcuggccaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgcggaccugaaguccacccaggccgccaucaaccagaucaacggcaagcucaaccgccugaucggcaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacucggagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacgucuaccgcgacgaggcccugaacaaccgguuccagaucaagggcguggagcugaaguccggcuacaaggacuggauccucuggaucuccuucgccaugagcugcuuccugcugugcguggcccuccugggguucaucaugugggcgugccagaagggcaacauccgcugcaacaucugcaucuga

SEQ ID NO: 2128 - RNA, 1701 nt, Artificial Sequence; identical to SEQ ID NO: 2073
  derived and/or modified CDS sequence (AUadapt) from InfluenzaA__ABU92737__HA

SEQ ID NO: 2129 - RNA, 1701 nt, Artificial Sequence
  derived and/or modified CDS sequence (AUadapt) from InfluenzaA__ABU92738__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccccgggccggaucaccgucuccacgaagcgcucgcagcagaccgugauccccaacaucggcucgcggccccgcgugcgggacauccccucccgcaucagcaucuacuggaccaucgucaagccgggggacauccugcucaucaacuccaccggcaaccugaucgcgccccggggguacuucaagauccgcucgggcaaguccagcaucaugcgguccgacgcccccaucggcaagugcaacucggagugcaucacgcccaacggguccaucccgaacgacaagcccuuccagaacgugaaccgcaucaccuacggcgccugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggugcugcucggguucaucaugugggccugccagaagggcaacauccggugcaacaucugcaucuga

SEQ ID NO: 2130 - RNA, 1701 nt, Artificial Sequence; identical to SEQ ID NO: 2007
  derived and/or modified CDS sequence (AUadapt) from InfluenzaA__ABU92739__HA

SEQ ID NO: 2131 - RNA, 1701 nt, Artificial Sequence
  derived and/or modified CDS sequence (AUadapt) from InfluenzaA__ABU92740__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacacgcugcucggggacccccagugcgacggcuuccagaacaagaagugggaccuguucguggagcgcagcaaggccuacuccaacugcuaccccuacgacgugccggacuacgccucgcugcggucccucgucgcgagcuccggcacccuggaguucaacaacgagucguucaacuggaccggggugacccagaacggcacguccucggccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcccaggcgucggggcggaucacgguguccaccaagcgcagccagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacucggaggggaucggccaggccgccgaccugaaguccacccaggccgcgaucaaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacauggggaacggcugcuucaagaucuaccacaagugcgacaacgccugcaucggguccauccgcaacggcacguacgaccacgacgucuaccgggacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2132 - RNA, 1701 nt, Artificial Sequence
  derived and/or modified CDS sequence (AUadapt) from InfluenzaA__ABU92741__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacgcuggaguucaacaacgagagcuucaacuggaccggcgucacccagaacgggaccuccucggccugcaagcgccgguccaacaacucguucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccccgggccggaucaccgucuccacgaagcgcucgcagcagaccgugauccccaacaucggcucgcggccccgcgugcgggacauccccucccgcaucagcaucuacuggaccaucgucaagccgggggacauccugcucaucaacuccaccggcaaccugaucgcgccccggggguacuucaagauccgcucgggcaaguccagcaucaugcgguccgacgcccccaucggcaagugcaacucggagugcaucacgcccaacggguccaucccgaacgacaagcccuuccagaacgugaaccgcaucaccuacggcgccugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacaucuaccgggacgaggcccucaacaaccgcuuccagaucaagggcguggagcugaaguccggcuacaaggacuggauccuguggaucuccuucgccaucagcugcuuccuccugugcgucgugcugcucggguucaucaugugggccugccagaagggcaacauccggugcaacaucugcaucuga

SEQ ID NO: 2133 - RNA, 1701 nt, Artificial Sequence; identical to SEQ ID NO: 2073
  derived and/or modified CDS sequence (AUadapt) from InfluenzaA__ABU92742__HA

SEQ ID NO: 2134 - RNA, 1701 nt, Artificial Sequence
  derived and/or modified CDS sequence (AUadapt) from InfluenzaA__ABU92743__HA
augaagaccaucaucgcccugucguacauccucuaccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgggaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2135 - RNA, 1701 nt, Artificial Sequence; identical to SEQ ID NO: 2073
  derived and/or modified CDS sequence (AUadapt) from InfluenzaA__ABU92744__HA

SEQ ID NO: 2136 - RNA, 1701 nt, Artificial Sequence
  derived and/or modified CDS sequence (AUadapt) from InfluenzaA__ABU92745__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucaucgccucguccgggacgcuggaguucaacaacgagagcuucaacuggaccggcgucacccagaacgggaccuccucggccugcaagcgccgguccaacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucucgcuguacgcgcaggccccgggccggaucaccgucuccacgaagcgcucgcagcagaccgugauccccaacaucggcagccggccccgcgugcgggacauccccucccgcaucucgaucuacuggaccaucgucaagccgggggacauccugcucaucaacuccaccggcaaccugaucgcgccccggggguacuucaagauccgcaucggcaagagcuccaucaugcggucggacgcccccaucggcaagugcaacuccgagugcaucacgcccaacgggucgaucccgaacgacaagcccuuccagaacgugaaccgcaucaccuacggcgccugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggugcugcucggguucaucaugugggccugccagaagggcaacauccggugcaacaucugcaucuga

SEQ ID NO: 2137 - RNA, 1701 nt, Artificial Sequence; identical to SEQ ID NO: 2073
  derived and/or modified CDS sequence (AUadapt) from InfluenzaA__ABU92746__HA

SEQ ID NO: 2138 - RNA, 1701 nt, Artificial Sequence; identical to SEQ ID NO: 318
  derived and/or modified CDS sequence (AUadapt) from InfluenzaA__ABU92747__HA

SEQ ID NO: 2139 - RNA, 1701 nt, Artificial Sequence
  derived and/or modified CDS sequence (AUadapt) from InfluenzaA__ABU92748__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcacucgaaguucaaguaccccgcccugaacgugaccaugcccaacaacgagaaguucgacaagcuguacaucuggggcguccaccaccccgggaccgacaacgaccagaccuuccucuacgcgcaggccuccgggcggaucacggugagcaccaagcgcucgcagcagaccgugaucccgaacaucggcucccggccccgcguccggaacauccccagccgcaucuccaucuacuggaccaucgugaagcccggcgacauccugcugaucaacucgacggggaaccucaucgccccgcggggcuacuucaagauccgcuccgggaaguccuccaucaugcggucggacgcccccaucggcaagugcaacuccgagugcaucacccccaacggcagcauccccaacgacaagccguuccagaacgugaaccgcaucaccuacggggccugcccccgguacgucaagcagaacacccugaagcuggcgacgggcaugcgcaacgugcccgagaagcagacccgggggaucuucggcgccaucgccggguucaucgagaacggcugggagggcaugguggacgggugguacggcuuccgccaccagaacuccgaggggaucggccaggccgccgaccucaagucgacccaggcggccaucaaccagaucaacgggaagcugaaccggcugaucggcaagaccaacgagaaguuccaccagaucgagaaggaguucuccgaggucgagggccgcauccaggaccucgagaaguacguggaggacacgaagaucgaccuguggagcuacaacgccgagcugcucguggcccuggagaaccagcacaccaucgaccugaccgacuccgagaugaacaagcuguucgagcggaccaagaagcagcuccgcgagaacgccgaggacauggggaacggcugcuucaagaucuaccacaagugcgacaacgcgugcaucgggucgauccgcaacggcacguacgaccacgacgucuaccgggacgaggcccugaacaaccgcuuccagaucaaggggguggagcucaaguccggcuacaaggacuggauccuguggaucagcuucgccaucuccugcuuccugcucugcgugguccugcugggcuucaucaugugggccugccagaaggggaacauccggugcaacaucugcaucuga

SEQ ID NO: 2140 - RNA, 1701 nt, Artificial Sequence; identical to SEQ ID NO: 318
  derived and/or modified CDS sequence (AUadapt) from InfluenzaA__ABU92749__HA

SEQ ID NO: 2141 - RNA, 1701 nt, Artificial Sequence
  derived and/or modified CDS sequence (AUadapt) from InfluenzaA__ABU92750__HA
augaagaccaucaucgcccugucguacauccucugccugguguucgcccagaagcugcccggcaacgacaaccgcaccgcgacgcucugccuggggcaccacgccgucccgaacggcaccaucgugaagaccaucaccaacgaccagaucgaggugacgaacgccaccgagcugguccagaucuccucgaccgggggcaucugcgacagcccccaccagauccucgacggggagaacugcacccugaucgacgcccugcucggcgacccccagugcgacggcuuccagaacaagaagugggaccuguucguggagcggucgaaggccuacuccaacugcuaccccuacgacgugccggacuacgcgucgcugcgcucccucgucgccagcuccgggacgcuggaguucaacaacgagucguucgacuggaccggcgugacccagaacgggaccuccucggccugcaagcggcgcuccaacaagagcuucuucucccggcugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccgcaucaccguguccacgaagcggagccagcagaccgugaucccgaacaucggcucgcgcccccggguccgcgacguguccucgcggaucuccaucuacuggaccaucgugaagcccggggacauccugcucaucaacagcaccggcaaccugaucgcgccccgcggguacuucaagauccgguccggcaagucguccaucaugcgcucggacgccccgaucggcaagugcaacuccgagugcaucacgcccaacgggagcauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcucgauccggaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 2142 - RNA, 1701 nt, Artificial Sequence
  derived and/or modified CDS sequence (AUadapt) from InfluenzaA__ABU92751__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccagcggccggaucaccgugucgacgaagcgcucccagcagaccgugaucccgaacaucggcucgcggccccgcguccgggacguguccagccgcaucuccaucuacuggaccaucgugaagcccggggacauccugcucaucaacucgaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucucguucgccaucagcugcuuccuccugugcgucgcccugcucggguucaucaugugggccugccagaagggcaacauccggugcaacaucugcaucuga

SEQ ID NO: 2143 - RNA, 1701 nt, Artificial Sequence; identical to SEQ ID NO: 2007
  derived and/or modified CDS sequence (AUadapt) from InfluenzaA__ABU92752__HA

SEQ ID NO: 2144 - RNA, 1701 nt, Artificial Sequence; identical to SEQ ID NO: 318
  derived and/or modified CDS sequence (AUadapt) from InfluenzaA__ABU92753__HA

SEQ ID NO: 2145 - RNA, 1701 nt, Artificial Sequence; identical to SEQ ID NO: 2007
  derived and/or modified CDS sequence (AUadapt) from InfluenzaA__ABU92754__HA

SEQ ID NO: 2146 - RNA, 1701 nt, Artificial Sequence
  derived and/or modified CDS sequence (AUadapt) from InfluenzaA__ABU92755__HA
augaagaccaucaucgcccugucguacauccucugccugguguucgcccagaagcugcccggcaacgacaacgggaccgcgacgcucugccugggccaccacgccgucccgaacgggaccaucgugaagaccaucaccaacgaccagaucgaggugacgaacgccaccgagcugguccaguccucguccaccggcgggaucugcgacucgccccaccagauccucgacggcgagaacugcacccugaucgacgcccugcucggcgacccccagugcgacggguuccagaacaagaagugggaccuguucguggagcgcuccaaggccuacagcaacugcuaccccuacgacgugccggacuacgcgucccugcggucgcucgucgccuccucgggcacgcuggaguucaacaacgaguccuucaacuggaccggggugacccagaacggcaccagcuccgccugcaagcgccggucgaacaaguccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcgcaggccagcggccggaucaccguguccacgaagcgcucgcagcagaccgugaucccgaacaucgggucgcggccccgcguccgggacgugcccucccgcaucucgaucuacuggaccaucgugaagcccggcgacauccugcucaucaacuccaccgggaaccugaucgccccgcggggcuacuucaagauccgcagcggcaaguccucgaucaugcgguccgacgcccccaucgggaagugcaacucggagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggcuucaucgagaacgggugggagggcauggucgacgggugguacggcuuccgccaccagaacgccgaggggaccggccaggccgcggaccucaagagcacccaggccgccaucaaccagaucaacggcaagcugaaccggcugaucgggaagaccaacgagaaguuccaccagaucgagaaggaguucuccgagguggagggccgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgcggaggacauggggaacggcugcuucaagaucuaccacaagugcgacaacgccugcaucgggucgauccgcaacggcacguacgaccacaacguguaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagaaggggaacauccggugcaacaucugcaucuga

SEQ ID NO: 2147 - RNA, 1701 nt, Artificial Sequence
  derived and/or modified CDS sequence (AUadapt) from InfluenzaA__ABU92756__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccgggggcaucugcgacucgccccaccagauccucgacggggagaacugcacccugaucgacgcccugcucggcgacccccagugcgacggcuuccagaacaagaagugggaccuguucguggagcgcuccaaggcccacagcaacugcuaccccuacgacgugccggacuacgcgucccugcggucgcucgucgccuccucggggacgcuggaguucaacaacgaguccuucgacuggaccggcgugacccagaacgggaccagcuccgccugcaagcgccggucgaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugucgacgaagcgcucgcagcagaccgugaucccgaacaucggcucccggccccgcguccgggacgugagcucccgcaucucgaucuacuggaccaucgugaagcccggggacauccugcucaucaacuccaccggcaaccugaucgcgccccggggguacuucaagauccgcucgggcaaguccagcaucaugcgguccgacgccccgaucggcaagugcaacucggagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacucggagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 2148 - RNA, 1701 nt, Artificial Sequence
  derived and/or modified CDS sequence (AUadapt) from InfluenzaA__ABU92757__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucgacuggaccggggugacccagaacggcaccucguccgccugcaagcgccggucggacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccgggcggaucaccgugucgacgaagcgcagccagcagaccgugaucccgaacaucggcucccggccccgcguccgggacgugucgucccgcaucucgaucuacuggaccaucgugaagcccggcgacauccugcucaucaacuccaccgggaaccugaucgcgccccggggcuacuucaagauccgccggggcaagagcuccaucaugcgcucggacgccccgaucgggaagugcaacuccgagugcaucacgcccaacggcucgauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacuccgaggggaccggccaggccgccgaccucaagagcacccaggcggccaucaaccagaucaacgggaagcugaaccgccugaucggcaagaccaacgagaaguuccaccagaucgagaaggaguucuccgagguggagggccggauccaggaccuggagaaguacguggaggacacgaagaucgaccuguggucguacaacgccgagcuccuggucgcccuggagaaccagcacaccaucgaccucaccgacuccgagaugaacaagcuguucgagcgcaccaagaagcagcugcgcgagaacgccgaggacauggggaacggcugcuucaagaucuaccacaagugcgacaacgcgugcaucgggucgauccggaacggcacguacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 2149 - RNA, 1701 nt, Artificial Sequence; identical to SEQ ID NO: 2007
  derived and/or modified CDS sequence (AUadapt) from InfluenzaA__ABU92758__HA

SEQ ID NO: 2150 - RNA, 1701 nt, Artificial Sequence; identical to SEQ ID NO: 2007
  derived and/or modified CDS sequence (AUadapt) from InfluenzaA__ABU92759__HA

SEQ ID NO: 2151 - RNA, 1701 nt, Artificial Sequence
  derived and/or modified CDS sequence (AUadapt) from InfluenzaA__ABU92760__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcaacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggucgcucgucgccuccagcggcacgcuggaguucaacaacgaguccuucgacuggaccggggugacccagaacggcaccucguccgccugcaagcgccggucggacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccgggcggaucaccgugagcacgaagcgcucgcagcagaccgugaucccgaacaucggcucccggccccgcguccgggacgugucgucccgcaucagcaucuacuggaccaucgugaagcccggcgacauccugcucaucaacuccaccgggaaccugaucgcgccccggggcuacuucaagauccgcucggggaaguccucgaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggaccggccaggccgccgaccugaaguccacccaggcggccaucaaccagaucaacgggaagcugaaccggcucaucggcaagaccaacgagaaguuccaccagaucgagaaggaguucucggagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagucgggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 2152 - RNA, 1698 nt, Artificial Sequence
  derived and/or modified CDS sequence (AUadapt) from InfluenzaA__ABV29579__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagaagcggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 2153 - RNA, 1698 nt, Artificial Sequence
  derived and/or modified CDS sequence (AUadapt) from InfluenzaA__ABV29612__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagguggccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 2154 - RNA, 1698 nt, Artificial Sequence
  derived and/or modified CDS sequence (AUadapt) from InfluenzaA__ABV29634__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggaggcccccucccccgagaacgggaccugcuaccccggcuacuucgccgacuacgaggagcugcgcgagcagcucagcuccgugucguccuucgagcgguucgagaucuucccgaaggagagcuccuggcccaaccacacggucaccggggugagcgccuccugcagccacaacggcaaguccagcuucuaccgcaaccugcuguggcucaccgggaagaacggccuguaccccaaccuguccaagucguacgccaacaacaaggagaaggaggugcucguccuguggggcgugcaccacccgcccaacaucggcgaccagcgggcccuguaccacaccgagaacgccuacgugagcgucguguccagccacuacucccgccgguucacgcccgagaucgcgaagcgccccaaggugcgggaccaggagggccgcaucaacuacuacuggacccuccuggagcccggggacaccaucaucuucgaggccaacggcaaccugaucgccccgcgguucgccuucgcccucagccgcggguucggcuccggcaucaucaccagcaacgcgcccaugggggagugcgacgccaagugccagacgccccagggcgccaucaacuccucgcugcccuuccagaacguccacccggugaccaucggggagugccccaaguacgugcgguccgccaagcugcgcauggucaccggccuccggaacauccccagcauccagucccgcgggcuguucggcgccaucgcgggcuucaucgagggcggguggaccgggaugguggacggcugguacggguaccaccaccagaacgagcagggcagcggcuacgccgccgaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguuccuggacaucuggacguacaacgcggagcugcucgugcugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcaccuacgacuaccccaaguacucggaggaguccaagcucaaccgcgagaagaucgacggcgugaagcuggagagcaugggggucuaccagauccuggccaucuacagcaccguggccuccagccucgugcugcuggucucccucggcgccaucagcuucuggaugugcuccaacgggagccugcagugccggaucugcaucuga

SEQ ID NO: 2155 - RNA, 1698 nt, Artificial Sequence
  derived and/or modified CDS sequence (AUadapt) from InfluenzaA__ABV29645__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagucgaagcucaaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 2156 - RNA, 1698 nt, Artificial Sequence; identical to SEQ ID NO: 2155
  derived and/or modified CDS sequence (AUadapt) from InfluenzaA__ABV29667__HA

SEQ ID NO: 2157 - RNA, 1698 nt, Artificial Sequence
  derived and/or modified CDS sequence (AUadapt) from InfluenzaA__ABV29678__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccguggacgagugcgacgcgaagugccagacgccccagggggccaucaacagcucccugcccuuccagaacguccacccggugaccaucggcgagugccccaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 2158 - RNA, 1698 nt, Artificial Sequence
  derived and/or modified CDS sequence (AUadapt) from InfluenzaA__ABV29689__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccucguggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaucggcaugguggacgggugguacggcuaccaccaccagaacgagcagggguccggcuacgccgcggaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacucgaacgugaagaaccuguacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggcgaucuacagcacgguggccagcucccucgugcugcuggucagccucggggccaucuccuucuggaugugcagcaacggcucccugcagugccggaucugcaucuga

SEQ ID NO: 2159 - RNA, 1698 nt, Artificial Sequence
  derived and/or modified CDS sequence (AUadapt) from InfluenzaA__ABV29700__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 2160 - RNA, 1701 nt, Artificial Sequence
  derived and/or modified CDS sequence (AUadapt) from InfluenzaA__ABV29711__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccagagcgggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2161 - RNA, 1701 nt, Artificial Sequence
  derived and/or modified CDS sequence (AUadapt) from InfluenzaA__ABV29722__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguuccuggaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcguggcccuccugggcuucaucaugugggccugccagaaggggaacauccgcugcaacaucugcaucuga

SEQ ID NO: 2162 - RNA, 1698 nt, Artificial Sequence
  derived and/or modified CDS sequence (AUadapt) from InfluenzaA__ABV29733__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacaagugcgacgcgaagugccagacgccccagggggccaucaacagcucccugcccuuccagaacguccacccggugaccaucggcgagugccccaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcgacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 2163 - RNA, 1698 nt, Artificial Sequence; identical to SEQ ID NO: 2155
  derived and/or modified CDS sequence (AUadapt) from InfluenzaA__ABV29744__HA

SEQ ID NO: 2164 - RNA, 1698 nt, Artificial Sequence
  derived and/or modified CDS sequence (AUadapt) from InfluenzaA__ABV29755__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccucccccgagaacggcacgugcuaccccggcuacuucgccgacuacgaggagcugcgcgagcagcucagcuccgugucguccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagucguacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggggaagugcgacgcgaagugccagacgccccagggcgccaucaacuccucgcugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacucggaggaguccaagcucaaccgcgagaagaucgacggcgugaagcuggagagcaugggggucuaccagauccuggccaucuacagcacgguggccuccagccucgugcugcuggucucccucggcgccaucagcuucuggaugugcuccaacgggagccugcagugccggaucugcaucuga

SEQ ID NO: 2165 - RNA, 1698 nt, Artificial Sequence; identical to SEQ ID NO: 2155
  derived and/or modified CDS sequence (AUadapt) from InfluenzaA__ABV29766__HA

SEQ ID NO: 2166 - RNA, 1698 nt, Artificial Sequence
  derived and/or modified CDS sequence (AUadapt) from InfluenzaA__ABV29777__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacaagugcgacgcgaagugccagacgccccagggggccaucaacagcucccugcccuuccagaacguccacccggugaccaucggcgagugccccaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 2167 - RNA, 1698 nt, Artificial Sequence; identical to SEQ ID NO: 2155
  derived and/or modified CDS sequence (AUadapt) from InfluenzaA__ABV29788__HA

SEQ ID NO: 2168 - RNA, 1698 nt, Artificial Sequence; identical to SEQ ID NO: 2159
  derived and/or modified CDS sequence (AUadapt) from InfluenzaA__ABV29799__HA

SEQ ID NO: 2169 - RNA, 1701 nt, Artificial Sequence
  derived and/or modified CDS sequence (AUadapt) from InfluenzaA__ABV29821__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagguguuccuguacgcgcaggccagcgggcggaucaccguguccacgaagcgcucgcagcagaccgucaucccgaacaucggcagccggccccgcgugcggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacaucaagugcaacaucugcaucuga

SEQ ID NO: 2170 - RNA, 1698 nt, Artificial Sequence; identical to SEQ ID NO: 2159
  derived and/or modified CDS sequence (AUadapt) from InfluenzaA__ABV29832__HA

SEQ ID NO: 2171 - RNA, 1698 nt, Artificial Sequence; identical to SEQ ID NO: 2155
  derived and/or modified CDS sequence (AUadapt) from InfluenzaA__ABV29865__HA

SEQ ID NO: 2172 - RNA, 1698 nt, Artificial Sequence; identical to SEQ ID NO: 2155
  derived and/or modified CDS sequence (AUadapt) from InfluenzaA__ABV29876__HA

SEQ ID NO: 2173 - RNA, 1701 nt, Artificial Sequence
  derived and/or modified CDS sequence (AUadapt) from InfluenzaA__ABV29898__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2174 - RNA, 1701 nt, Artificial Sequence
  derived and/or modified CDS sequence (AUadapt) from InfluenzaA__ABV29909__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccucggaccagaucgaggugacgaacgccaccgagcugguccagaacuccagcaucgggggcaucugcaacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucaucgccucguccgggacccuggaguucaacaacgagagcuucaacuggacgggcgucacccagaacgggaccuccucggccugcaagcgccgguccaacaacucguucuucucccgccugaacuggcucacccaccugaaguucaaguaccccgcccugaacgugacgaugcccaacaacgaggaguucgacaagcucuacaucuggggcgugcaccaccccgggaccgacaacgaccagaucagccuguacgcgcaggccccgggccggaucaccgucuccaccaagcgcucgcagcagacggugauccccaacaucggcucgcggccccgcgugcgggacauccccucccgcaucagcaucuacuggaccaucgucaagccgggggacauccugcucaucaacuccaccggcaaccugaucgcgccccggggguacuucaagauccgcucgggcaaguccagcaucaugcgguccgacgcccccaucgacaagugcaacucggagugcaucacccccaacggcuccaucccgaacgacaagcccuuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggaucggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2175 - RNA, 1698 nt, Artificial Sequence
  derived and/or modified CDS sequence (AUadapt) from InfluenzaA__ABV29920__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 2176 - RNA, 1698 nt, Artificial Sequence; identical to SEQ ID NO: 2166
  derived and/or modified CDS sequence (AUadapt) from InfluenzaA__ABV29942__HA

SEQ ID NO: 2177 - RNA, 1698 nt, Artificial Sequence; identical to SEQ ID NO: 2159
  derived and/or modified CDS sequence (AUadapt) from InfluenzaA__ABV29953__HA

SEQ ID NO: 2178 - RNA, 1698 nt, Artificial Sequence; identical to SEQ ID NO: 2159
  derived and/or modified CDS sequence (AUadapt) from InfluenzaA__ABV29964__HA

SEQ ID NO: 2179 - RNA, 1698 nt, Artificial Sequence; identical to SEQ ID NO: 2155
  derived and/or modified CDS sequence (AUadapt) from InfluenzaA__ABV29986__HA

SEQ ID NO: 2180 - RNA, 1698 nt, Artificial Sequence; identical to SEQ ID NO: 2159
  derived and/or modified CDS sequence (AUadapt) from InfluenzaA__ABV29997__HA

SEQ ID NO: 2181 - RNA, 1698 nt, Artificial Sequence; identical to SEQ ID NO: 2155
  derived and/or modified CDS sequence (AUadapt) from InfluenzaA__ABV30008__HA

SEQ ID NO: 2182 - RNA, 1698 nt, Artificial Sequence; identical to SEQ ID NO: 2159
  derived and/or modified CDS sequence (AUadapt) from InfluenzaA__ABV30019__HA

SEQ ID NO: 2183 - RNA, 1698 nt, Artificial Sequence; identical to SEQ ID NO: 2159
  derived and/or modified CDS sequence (AUadapt) from InfluenzaA__ABV30030__HA

SEQ ID NO: 2184 - RNA, 1698 nt, Artificial Sequence
  derived and/or modified CDS sequence (AUadapt) from InfluenzaA__ABV30041__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaccgcgccccuccagcuggggaacugcuccgucgccggcuggauccuggggaacccggagugcgagcuccugaucagcaaggaguccuggucguacaucguggagacgcccaaccccgagaacgggaccugcuaccccggcuacuucgccgacuacgaggagcugcgcgagcagcucuccagcguguccagcuucgagcgguucgagaucuucccgaaggaguccagcuggcccaaccacaccgucaccgggguguccgccucgugcucccacaacggcaagagcuccuucuaccgcaaccugcuguggcucacggggaagaacggccuguaccccaaccugagcaaguccuacgccaacaacaaggagaaggaggugcucguccuguggggcgugcaccacccgcccaacaucggcgaccagcgggcccuguaccacaccgagaacgccuacgugucggucgugagcucccacuacagccgccgguucacccccgagaucgccaagcgccccaaggugcgggaccaggagggccgcaucaacuacuacuggacccuccuggagcccggggacacgaucaucuucgaggcgaacggcaaccugaucgccccgcgguucgccuucgcccucucccgcggguucggcagcggcaucaucaccuccaacgcccccaugggggagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacucggucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagaaccagcugaagaacaacgcgaaggagaucggcaacgggugcuucgaguucuaccacaagugcaacgacgagugcauggaguccgugaagaacggcacguacgacuaccccaaguacagcgaggaguccaagcucaaccgcgagaagaucgacggcgugaagcuggagagcaugggggucuaccagauccuggccaucuacuccaccguggccucgagccucgugcugcugaucucccucggcgccaucagcuucuggaugugcuccaacgggagccugcagugccggaucugcaucuga

SEQ ID NO: 2185 - RNA, 1701 nt, Artificial Sequence; identical to SEQ ID NO: 2173
  derived and/or modified CDS sequence (AUadapt) from InfluenzaA__ABV30063__HA

SEQ ID NO: 2186 - RNA, 1701 nt, Artificial Sequence; identical to SEQ ID NO: 2173
  derived and/or modified CDS sequence (AUadapt) from InfluenzaA__ABV30074__HA

SEQ ID NO: 2187 - RNA, 1698 nt, Artificial Sequence; identical to SEQ ID NO: 2159
  derived and/or modified CDS sequence (AUadapt) from InfluenzaA__ABV30085__HA

SEQ ID NO: 2188 - RNA, 1698 nt, Artificial Sequence; identical to SEQ ID NO: 2159
  derived and/or modified CDS sequence (AUadapt) from InfluenzaA__ABV30096__HA

SEQ ID NO: 2189 - RNA, 1698 nt, Artificial Sequence; identical to SEQ ID NO: 2155
  derived and/or modified CDS sequence (AUadapt) from InfluenzaA__ABV30107__HA

SEQ ID NO: 2190 - RNA, 1698 nt, Artificial Sequence
  derived and/or modified CDS sequence (AUadapt) from InfluenzaA__ABV30129__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcaacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 2191 - RNA, 1698 nt, Artificial Sequence
  derived and/or modified CDS sequence (AUadapt) from InfluenzaA__ABV30140__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccucaagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugucguccuucgagcgcuucgagaucuucccgaaggagagcuccuggcccaaccacaccgucaccggggugagcgccuccugcagccacaacggcaaguccucguucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 2192 - RNA, 1698 nt, Artificial Sequence
  derived and/or modified CDS sequence (AUadapt) from InfluenzaA__ABV30151__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacagcggcaaguccagcuucuaccgcaaccugcuguggcucaccgggaagaacggccuguaccccaaccuguccaagucguacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccaugggggagugcgacgcgaagugccagacgccccagggcgccaucaacuccucgcugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacucggaggaguccaagcucaaccgcgagaagaucgacggcgugaagcuggagagcaugggggucuaccagauccuggccaucuacagcacgguggccuccagccucgugcugcuggucucccucggcgccaucagcuucuggaugugcuccaacgggagccugcagugccggaucugcaucuga

SEQ ID NO: 2193 - RNA, 1698 nt, Artificial Sequence
  derived and/or modified CDS sequence (AUadapt) from InfluenzaA__ABV30162__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagacccccaaccccgagaacggcacgugcuaccccggcuacuucgccgacuacgaggagcugcgggagcagcucuccagcguguccucguucgagcgcuucgagaucuucccgaaggaguccagcuggcccaaccacaccgucaccgggguguccgccagcugcucccacaacggcaagagcuccuucuaccggaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacgccuacgugucggucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucgaccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 2194 - RNA, 1698 nt, Artificial Sequence; identical to SEQ ID NO: 2159
  derived and/or modified CDS sequence (AUadapt) from InfluenzaA__ABV30173__HA

SEQ ID NO: 2195 - RNA, 1698 nt, Artificial Sequence; identical to SEQ ID NO: 2159
  derived and/or modified CDS sequence (AUadapt) from InfluenzaA__ABV30184__HA

SEQ ID NO: 2196 - RNA, 1701 nt, Artificial Sequence; identical to SEQ ID NO: 2173
  derived and/or modified CDS sequence (AUadapt) from InfluenzaA__ABV30217__HA

SEQ ID NO: 2197 - RNA, 1701 nt, Artificial Sequence; identical to SEQ ID NO: 2173
  derived and/or modified CDS sequence (AUadapt) from InfluenzaA__ABV30228__HA

SEQ ID NO: 2198 - RNA, 1701 nt, Artificial Sequence
  derived and/or modified CDS sequence (AUadapt) from InfluenzaA__ABV30261__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagguggaggucacgaacgccaccgagcuggugcagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgucccggacuacgcgagccugcggucccucguggccucguccgggacgcuggaguucaacaacgagagcuucaacugggccggcgugacccagaacgggaccuccucggccugcaagcgcggcuccaacaacagcuucuucucccggcugaacuggcucacccacucgaaguucaaguaccccgcgcugaacgucacgaugcccaacaacgaggaguucgacaagcuguacaucuggggcgugcaccaccccgggaccgacaacgaccagaucuuccucuacgcccaggccuccggccgcaucaccgugagcaccaagcggucgcagcagacggucaucccgaacaucgggucccgcccccgggugcgcaacauccccagccggaucuccaucuacuggaccaucgugaagcccggcgacauccugcugaucaacucgaccgggaaccucaucgccccgcgcggcuacuucaagauccgguccggcaagagcuccaucaugcgcucggacgcccccaucgggaagugcaacuccgagugcaucacccccaacggcagcauccccaacgacaagccguuccagaacgucaaccggaucacguacggggcgugcccccgcuacgugaagcagaacacccugaagcuggccaccggcaugcggaacgugcccgagaagcagacccgcgggaucuucggcgccaucgccggcuucaucgagaacgggugggagggcauggucgacgggugguacggcuuccggcaccagaacuccgaggggaugggccaggccgcggaccucaagucgacgcaggccgccaucgaccagaucaacggcaagcugaaccgccugaucgggaagaccaacgagaaguuccaccagaucgagaaggaguucuccgagguggagggccggauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccggaacggcaccuacgaccacgacguguaccgcgccgaggcccugaacaaccgcuuccagaucaagggcguggagcucaaguccggguacaaggacuggauccuguggaucagcuucgccaucuccugcuuccugcucugcgucgcgcugcugggcuucaucaugugggccugccagaaggggaacauccggugcaacaucugcaucuga

SEQ ID NO: 2199 - RNA, 1701 nt, Artificial Sequence
  derived and/or modified CDS sequence (AUadapt) from InfluenzaA__ABV30272__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucuccaagcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcgcaucaccguguccacgaagcggucgcagcagaccgugaucccgaacaucggcagccgcccccggguccgcaacauccccucccggaucucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2200 - RNA, 1698 nt, Artificial Sequence
  derived and/or modified CDS sequence (AUadapt) from InfluenzaA__ABV30283__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcaacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucgacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 2201 - RNA, 1698 nt, Artificial Sequence
  derived and/or modified CDS sequence (AUadapt) from InfluenzaA__ABV30294__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugucguccuucgagcgcuucgagaucuucccgaaggagagcuccuggcccaaccacaccgucaccggggugagcgccuccugcagccacaacggcaaguccucguucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 2202 - RNA, 1698 nt, Artificial Sequence
  derived and/or modified CDS sequence (AUadapt) from InfluenzaA__ABV30305__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggggcuccgccagcugcucccacaacggcaagucguccuucuaccgcaaccugcuguggcucaccgggaagaacgggcuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacucgcgccgguucacccccgagaucgccaagcgccccaaggugcgggaccaggaggggcgcaucaacuacuacuggacccuccuggagcccggcgacaccaucaucuucgaggcgaacgggaaccugaucgccccgcgguucgccuucgcccucucccgcggcuucggcagcgggaucaucacguccaacgcccccauggacgagugcgacgcgaagugccagacgccccagggcgccaucaacagcucccugcccuuccagaacgugcacccggucaccaucggggagugccccaaguacgugcggagcaccaagcugcgcauggugaccggccuccggaacauccccuccauccagucgcgcgggcuguucggcgccaucgccggcuucaucgagggcggguggaccgggauggucgacggcugguacggguaccaccaccagaacgagcagggcuccggcuacgccgcggaccagaaguccacccagaacgccaucaacgggaucaccaacaaggugaacagcgugaucgagaagaugaacacgcaguucaccgccgucggcaaggaguucaacaagcuggagcggcgcauggagaaccucaacaagaagguggacgacggguuccuggacaucuggaccuacaacgccgagcugcucguccugcuggagaacgagcggacccucgacuuccacgacagcaacgugaagaaccuguacgagaaggugaagucccagcugaagaacaacgccaaggagaucggcaacgggugcuucgaguucuaccacaagugcaacaacgagugcauggagagcgucaagaacggcacguacgacuaccccaaguacuccgaggagucgaagcucaaccgcgagaagaucgacggcgugaagcuggaguccauggggguguaccagauccuggcgaucuacagcaccgucgccagcucccucgugcugcuggugagccucggcgccaucuccuucuggaugugcagcaacgggucccugcagugccggaucugcaucuga

SEQ ID NO: 2203 - RNA, 1698 nt, Artificial Sequence; identical to SEQ ID NO: 2155
  derived and/or modified CDS sequence (AUadapt) from InfluenzaA__ABV30316__HA

SEQ ID NO: 2204 - RNA, 1698 nt, Artificial Sequence; identical to SEQ ID NO: 2201
  derived and/or modified CDS sequence (AUadapt) from InfluenzaA__ABV30327__HA

SEQ ID NO: 2205 - RNA, 1698 nt, Artificial Sequence; identical to SEQ ID NO: 2155
  derived and/or modified CDS sequence (AUadapt) from InfluenzaA__ABV30338__HA

SEQ ID NO: 2206 - RNA, 1698 nt, Artificial Sequence; identical to SEQ ID NO: 2159
  derived and/or modified CDS sequence (AUadapt) from InfluenzaA__ABV30349__HA

SEQ ID NO: 2207 - RNA, 1698 nt, Artificial Sequence
  derived and/or modified CDS sequence (AUadapt) from InfluenzaA__ABV30360__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcaacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucgacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcaucaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 2208 - RNA, 1698 nt, Artificial Sequence; identical to SEQ ID NO: 2159
  derived and/or modified CDS sequence (AUadapt) from InfluenzaA__ABV30371__HA

SEQ ID NO: 2209 - RNA, 1701 nt, Artificial Sequence; identical to SEQ ID NO: 1974
  derived and/or modified CDS sequence (AUadapt) from InfluenzaA__ABV30382__HA

SEQ ID NO: 2210 - RNA, 1701 nt, Artificial Sequence; identical to SEQ ID NO: 875
  derived and/or modified CDS sequence (AUadapt) from InfluenzaA__ABV30393__HA

SEQ ID NO: 2211 - RNA, 1701 nt, Artificial Sequence
  derived and/or modified CDS sequence (AUadapt) from InfluenzaA__ABV30404__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaagugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgaccuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2212 - RNA, 1701 nt, Artificial Sequence
  derived and/or modified CDS sequence (AUadapt) from InfluenzaA__ABV30415__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucgucgccagcuccgggacgcuggaguucaacaacgagucguucaacugggccggcgugacccagaacgggaccuccagcgccugcaagcgcggcuccaacaacucguucuucucccggcugaacuggcucacccacagcaaguucaaguaccccgcgcugaacgugacgaugcccaacaacgaggaguucgacaagcuguacaucuggggcguccaccaccccgggaccgacaacgaccagaucuuccucuacgcccaggccuccggccgcaucaccgugucgaccaagcggagccagcagacggugaucccgaacaucgggucccgcccccggguccgcaacauccccucgcggaucuccaucuacuggaccaucgugaagcccggcgacauccugcugaucaacagcaccgggaaccucaucgccccgcgcggcuacuucaagauccgguccggcaagucguccaucaugcgcagcgacgcccccaucgggaagugcaacuccgagugcaucacccccaacggcucgauccccaacgacaagccguuccagaacgugaaccggaucacguacggggcgugcccccgcuacgucaagcagaacacccugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaucggccaggccgcggaccucaagagcacgcaggccgccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggucguacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacgacgucuaccgcgacgaggcccugaacaaccgcuuccagaucaaguccguggagcucaagucgggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 2213 - RNA, 1701 nt, Artificial Sequence; identical to SEQ ID NO: 2173
  derived and/or modified CDS sequence (AUadapt) from InfluenzaA__ABV30426__HA

SEQ ID NO: 2214 - RNA, 1701 nt, Artificial Sequence
  derived and/or modified CDS sequence (AUadapt) from InfluenzaA__ABV30437__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaaccacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2215 - RNA, 1701 nt, Artificial Sequence; identical to SEQ ID NO: 2173
  derived and/or modified CDS sequence (AUadapt) from InfluenzaA__ABV30448__HA

SEQ ID NO: 2216 - RNA, 1698 nt, Artificial Sequence
  derived and/or modified CDS sequence (AUadapt) from InfluenzaA__ABV30459__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgaggcccccaaccccgagaacgggaccugcuaccccggcuacuucgccgacuacgaggagcugcgcgagcagcucuccagcguguccucguucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacaccgagaacgccuacgugucgguggucagcucccacuacagccgccgguucacgcccgagaucgcgaagcgccccaaggugcgggaccaggagggccgcaucaacuacuacuggacccuccuggagcccggggacaccaucaucuucgaggccaacggcaaccugaucgccccgcgguucgccuucgcccucucccgcggguucggcagcggcaucaucaccuccaacgcgcccauggacgagugcgacgccaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggacgggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagucgaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 2217 - RNA, 1701 nt, Artificial Sequence; identical to SEQ ID NO: 2173
  derived and/or modified CDS sequence (AUadapt) from InfluenzaA__ABV30470__HA

SEQ ID NO: 2218 - RNA, 1698 nt, Artificial Sequence; identical to SEQ ID NO: 2155
  derived and/or modified CDS sequence (AUadapt) from InfluenzaA__ABV30492__HA

SEQ ID NO: 2219 - RNA, 1698 nt, Artificial Sequence
  derived and/or modified CDS sequence (AUadapt) from InfluenzaA__ABV30503__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccaucaccgggguguccgccagcugcucccacaacggcaagagcuccuucuaccgcaaccugcuguggcucaccgggaagaacggccuguaccccaaccugagcaaguccuacgccaacaacaaggagaaggagguccucgugcuguggggcgugcaccacccgcccaacaucggggaccagcgggcccuguaccacacggagaacgccuacgucucgguggugagcucccacuacagccgccgguucacccccgagaucgccaagcgccccaagguccgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggugaccaucggcgagugccccaaguacguccggucgaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgucaagcuggaguccaugggcguguaccagauccuggcgaucuacagcaccguggccagcucccucguccugcuggugagccucggggccaucuccuucuggaugugcagcaacggcucccugcagugccggaucugcaucuga

SEQ ID NO: 2220 - RNA, 1701 nt, Artificial Sequence; identical to SEQ ID NO: 2173
  derived and/or modified CDS sequence (AUadapt) from InfluenzaA__ABV30514__HA

SEQ ID NO: 2221 - RNA, 1698 nt, Artificial Sequence
  derived and/or modified CDS sequence (AUadapt) from InfluenzaA__ABV30525__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacagcggcaaguccagcuucuaccgcaaccugcuguggcucaccgggaagaacggccuguaccccaaccuguccaagucguacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacacccccaugggggagugcgacgccaagugccagacgccccagggcgcgaucaacuccucgcugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacucggaggaguccaagcucaaccgcgagaagaucgacggcgugaagcuggagagcaugggggucuaccagauccuggcgaucuacagcaccguggccuccagccucgugcugcuggucucccucggcgccaucagcuucuggaugugcuccaacgggagccugcagugccggaucugcaucuga

SEQ ID NO: 2222 - RNA, 1698 nt, Artificial Sequence; identical to SEQ ID NO: 2159
  derived and/or modified CDS sequence (AUadapt) from InfluenzaA__ABV30536__HA

SEQ ID NO: 2223 - RNA, 1698 nt, Artificial Sequence; identical to SEQ ID NO: 2166
  derived and/or modified CDS sequence (AUadapt) from InfluenzaA__ABV30547__HA

SEQ ID NO: 2224 - RNA, 1698 nt, Artificial Sequence; identical to SEQ ID NO: 2159
  derived and/or modified CDS sequence (AUadapt) from InfluenzaA__ABV30558__HA

SEQ ID NO: 2225 - RNA, 1698 nt, Artificial Sequence
  derived and/or modified CDS sequence (AUadapt) from InfluenzaA__ABV30569__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacaaccacaacgggaagcucugccugcugaagggcaucgcgccccuccagcuggggaacugcagcguggccggcuggauccuggggaacccggagugcgagcuccugaucuccaaggagagcugguccuacaucgucgagacccccaaccccgagaacggcacgugcuaccccggcuacuucgccgacuacgaggagcugcgcgagcagcucagcuccgugucguccuucgagcgguucgagaucuucccgaaggagagcuccuggcccaaccacaccgugaccggggucagcgccuccugcagccacaacggcaaguccucguucuaccgcaaccugcuguggcucaccgggaagaacggccuguaccccaaccuguccaagagcuacgccaacaacaaggagaaggaggugcucgugcuguggggcguccaccacccgcccaacaucggggaccagcgggcccuguaccacacggagaacgccuacguguccguggucagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucacgagcaacgcccccauggacgagugcgacgcgaagugccagacgccccagggggccaucaacuccagccugcccuuccagaacgugcacccggucaccaucggcgagugccccaaguacgugcgguccaccaagcugcgcauggugaccgggcuccggaacauccccagcauccagucccgcggccuguucggggccaucgccggcuucaucgagggcggguggaccggcauggucgacgggugguacggcuaccaccaccagaacgagcaggggucgggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcucaaccgcgagaagaucgacggcgugaagcuggagucgaugggcguguaccagauccuggcgaucuacuccaccgucgccagcagccucgugcugcuggugucccucggggccaucagcuucuggaugugcuccaacggcagccugcagugccggaucugcaucuga

SEQ ID NO: 2226 - RNA, 1698 nt, Artificial Sequence; identical to SEQ ID NO: 2159
  derived and/or modified CDS sequence (AUadapt) from InfluenzaA__ABV30580__HA

SEQ ID NO: 2227 - RNA, 1698 nt, Artificial Sequence; identical to SEQ ID NO: 2155
  derived and/or modified CDS sequence (AUadapt) from InfluenzaA__ABV30591__HA

SEQ ID NO: 2228 - RNA, 1698 nt, Artificial Sequence; identical to SEQ ID NO: 2155
  derived and/or modified CDS sequence (AUadapt) from InfluenzaA__ABV30602__HA

SEQ ID NO: 2229 - RNA, 1698 nt, Artificial Sequence
  derived and/or modified CDS sequence (AUadapt) from InfluenzaA__ABV30613__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcaugaagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagucgaagcucaaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 2230 - RNA, 1698 nt, Artificial Sequence; identical to SEQ ID NO: 2155
  derived and/or modified CDS sequence (AUadapt) from InfluenzaA__ABV30624__HA

SEQ ID NO: 2231 - RNA, 1701 nt, Artificial Sequence
  derived and/or modified CDS sequence (AUadapt) from InfluenzaA__ABV30646__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccuacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2232 - RNA, 1701 nt, Artificial Sequence
  derived and/or modified CDS sequence (AUadapt) from InfluenzaA__ABV30657__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagguguuccuguacgcgcaggccagcgggcggaucaccguguccacgaagcgcucgcagcagaccgucaucccgaacaucggcagccggccccgcgugcggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 2233 - RNA, 1701 nt, Artificial Sequence; identical to SEQ ID NO: 2232
  derived and/or modified CDS sequence (AUadapt) from InfluenzaA__ABV45860__HA

SEQ ID NO: 2234 - RNA, 1698 nt, Artificial Sequence; identical to SEQ ID NO: 2200
  derived and/or modified CDS sequence (AUadapt) from InfluenzaA__ABV45871__HA

SEQ ID NO: 2235 - RNA, 1698 nt, Artificial Sequence; identical to SEQ ID NO: 2159
  derived and/or modified CDS sequence (AUadapt) from InfluenzaA__ABV45882__HA

SEQ ID NO: 2236 - RNA, 1698 nt, Artificial Sequence; identical to SEQ ID NO: 2166
  derived and/or modified CDS sequence (AUadapt) from InfluenzaA__ABV45893__HA

SEQ ID NO: 2237 - RNA, 1701 nt, Artificial Sequence; identical to SEQ ID NO: 1974
  derived and/or modified CDS sequence (AUadapt) from InfluenzaA__ABV45904__HA

SEQ ID NO: 2238 - RNA, 1698 nt, Artificial Sequence; identical to SEQ ID NO: 2166
  derived and/or modified CDS sequence (AUadapt) from InfluenzaA__ABV45926__HA

SEQ ID NO: 2239 - RNA, 1698 nt, Artificial Sequence
  derived and/or modified CDS sequence (AUadapt) from InfluenzaA__ABV45937__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgagacgaacggcaaccugaucgcgccgcgguucgccuucgcccucucccgcggguucggcagcggcaucaucaccuccaacgcccccaugggggagugcgacgccaagugccagacgccccagggcgcgaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgccaaggagaucggcaacgggugcuucgaguucuaccacaagugcaacgacgagugcauggagagcgugaagaacggcacguacgacuaccccaaguacuccgaggagucgaagcucaaccgcgagaagaucgacggcgugaagcuggaguccaugggggucuaccagauccuggcgaucuacagcaccguggccagcucccucgugcugcuggucagccucggcgccaucuccuucuggaugugcagcaacgggucccugcagugccggaucugcaucuga

SEQ ID NO: 2240 - RNA, 1698 nt, Artificial Sequence; identical to SEQ ID NO: 2192
  derived and/or modified CDS sequence (AUadapt) from InfluenzaA__ABV45948__HA

SEQ ID NO: 2241 - RNA, 1698 nt, Artificial Sequence; identical to SEQ ID NO: 2159
  derived and/or modified CDS sequence (AUadapt) from InfluenzaA__ABV45959__HA

SEQ ID NO: 2242 - RNA, 1701 nt, Artificial Sequence
  derived and/or modified CDS sequence (AUadapt) from InfluenzaA__ABV45970__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggaccacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccagucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2243 - RNA, 1701 nt, Artificial Sequence
  derived and/or modified CDS sequence (AUadapt) from InfluenzaA__ABV45981__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggaucaucuggaucuccuucgccaucagcugcuuccugcucugcguggcccugcugggcuucaucaugugggccugccagaaggggaacauccgcugcaacaucugcaucuga

SEQ ID NO: 2244 - RNA, 1698 nt, Artificial Sequence
  derived and/or modified CDS sequence (AUadapt) from InfluenzaA__ABV82551__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggcgacaccaucaucuucgaggcgaacgggaaccugaucgccccgcgguucgccuucgcccucucccgcggcuucgggagcggcaucaucacguccaacgcccccauggacaagugcgacgcgaagugccagacgccccagggcgccaucaacagcucccugcccuuccagaacguccacccggugaccaucggggagugccccaaguacgugcggucgaccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacccagaacgccaucaacggcaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgccaaggagaucggcaacgggugcuucgaguucuaccacaagugcaacgacgagugcauggagagcgugaagaacggcacguacgacuaccccaaguacuccgaggagucgaagcucaaccgcgagaagaucgacggggugaagcuggaguccaugggcgucuaccagauccuggcgaucuacagcaccguggccagcucccucgugcugcuggucagccucggcgccaucuccuucuggaugugcagcaacgggucccugcagugccggaucugcaucuga

SEQ ID NO: 2245 - RNA, 1701 nt, Artificial Sequence; identical to SEQ ID NO: 2173
  derived and/or modified CDS sequence (AUadapt) from InfluenzaA__ABV82562__HA

SEQ ID NO: 2246 - RNA, 1701 nt, Artificial Sequence; identical to SEQ ID NO: 2173
  derived and/or modified CDS sequence (AUadapt) from InfluenzaA__ABW36168__HA

SEQ ID NO: 2247 - RNA, 1698 nt, Artificial Sequence; identical to SEQ ID NO: 2159
  derived and/or modified CDS sequence (AUadapt) from InfluenzaA__ABW36179__HA

SEQ ID NO: 2248 - RNA, 1698 nt, Artificial Sequence; identical to SEQ ID NO: 2202
  derived and/or modified CDS sequence (AUadapt) from InfluenzaA__ABW36190__HA

SEQ ID NO: 2249 - RNA, 1698 nt, Artificial Sequence; identical to SEQ ID NO: 2159
  derived and/or modified CDS sequence (AUadapt) from InfluenzaA__ABW36201__HA

SEQ ID NO: 2250 - RNA, 1698 nt, Artificial Sequence
  derived and/or modified CDS sequence (AUadapt) from InfluenzaA__ABW36212__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggagaacuccuggcccaaccacaccgucaccggggugucggccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugucgagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcgggcugggcuccggcaucaucacgucgaacgcccccauggacgagugcgacgcgaagugccagacgccccagggggccaucaacuccagccugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacucggucaucgagaagaugaacacccaguucacggccguggggaaggaguucaacaagcucgagcggcgcauggagaaccugaacaagaaggucgacgacggcuuccuggacaucuggaccuacaacgccgagcuccuggugcugcucgagaacgagcggacccuggacuuccacgacuccaacgugaagaaccuguacgagaaggucaaggggcagcucaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcuggaguccaugggggucuaccagauccucgccaucuacucgacgguggccuccagccuggugcugcucgucagccugggcgccaucuccuucuggaugugcagcaacgggucccugcagugccggaucugcaucuga

SEQ ID NO: 2251 - RNA, 1698 nt, Artificial Sequence; identical to SEQ ID NO: 2155
  derived and/or modified CDS sequence (AUadapt) from InfluenzaA__ABW36223__HA

SEQ ID NO: 2252 - RNA, 1698 nt, Artificial Sequence; identical to SEQ ID NO: 2155
  derived and/or modified CDS sequence (AUadapt) from InfluenzaA__ABW36245__HA

SEQ ID NO: 2253 - RNA, 1698 nt, Artificial Sequence; identical to SEQ ID NO: 2155
  derived and/or modified CDS sequence (AUadapt) from InfluenzaA__ABW36267__HA

SEQ ID NO: 2254 - RNA, 1698 nt, Artificial Sequence; identical to SEQ ID NO: 2159
  derived and/or modified CDS sequence (AUadapt) from InfluenzaA__ABW36278__HA

SEQ ID NO: 2255 - RNA, 1698 nt, Artificial Sequence
  derived and/or modified CDS sequence (AUadapt) from InfluenzaA__ABW36289__HA
augaagcugaagcuccuggugcugcucugcaccuucaccgccacguacgccgacaccaucugcaucggcuaccacgcgaacaacucgaccgacaccgucgacacggugcuggagaagaacgugaccgucacccacuccgugaaccugcucgaggacagccacaacgggaagcugugccugcucaagggcaucgcgccccugcagcuggggaacugcuccguggccggcuggauccucgggaacccggagugcgagcugcugaucagcaaggaguccuggagcuacaucgucgagacccccaaccccgagaacggcacgugcuaccccggcuacuucgccgacuacgaggagcuccgcgagcagcuguccagcguguccucguucgagcgguucgagaucuucccgaaggaguccagcuggcccaaccacaccgugaccggggucuccgccagcugcucccacaacggcaagagcuccuucuaccgcaaccugcucuggcugaccgggaagaacggccuguaccccaaccucagcaaguccuacgccaacaacaaggagaaggaggugcuggugcuguggggcguccaccacccgcccaacaucggggaccagcgggcccucuaccacacggagaacgccuacgugucgguggucagcucccacuacagccgccgguucacccccgagaucgccaagcgccccaaggugcgggaccaggagggccgcaucaacuacuacuggacccugcuggagcccggggacaccaucaucuucgaggcgaacggcaaccucaucgccccgcgguucgccuucgcccugucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcuccgcauggugaccgggcugcggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcucgagcggcgcauggagaaccugaacaagaagguggacgacggcuuccuggacaucuggaccuacaacgccgagcuccugguccugcucgagaacgagcggacccuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggacguacgacuaccccaaguacuccgaggagucgaagcugaaccgcgagaagaucgacggcgugaagcuggaguccaugggcguguaccagauccucgcgaucuacagcaccgucgccagcucccuggugcugcucgugagccugggggccaucuccuucuggaugugcagcaacggcucccugcagugccggaucugcaucuga

SEQ ID NO: 2256 - RNA, 1698 nt, Artificial Sequence; identical to SEQ ID NO: 2166
  derived and/or modified CDS sequence (AUadapt) from InfluenzaA__ABW36300__HA

SEQ ID NO: 2257 - RNA, 1701 nt, Artificial Sequence
  derived and/or modified CDS sequence (AUadapt) from InfluenzaA__ABW36311__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcucgaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugucguccgugagcuccuucgagcgcuucgagaucuuccccaaggagcggagcuggccgaagcacaacgucacccgcggggugacggccuccugcucgcacaagggcaaguccagcuucuaccggaaccuccuguggcugaccgagaagaacggguccuaccccaaccucucgaagagcuacgugaacaacaaggagaaggagguccuggugcuguggggcgugcaccaccccuccaacaucgaggaccagaagaccaucuaccgcaaggagaacgccuacgucagcgugguguccucgaacuacaaccggcgcuucacccccgagaucgcgaagcggccgaagguccgcgaccaggaggggcggaucaacuacuacuggacgcuccuggagcccggcgacaccaucaucuucgaggccaacggcaaccugaucgcccccugguacgccuucgcccucucccgcggguucggcagcgggaucaucaccuccaacgcgagcauggacgagugcgacaccaagugccagacgccccagggcgccaucaacuccucgcugccguuccagaacgugcaccccgugaccaucggcgagugccccaaguacguccgguccaccaagcugcgcauggugaccgggcuccggaacauccccagcauccagucccgcggccuguucggggccaucgccggcuucaucgagggcggcuggacgggcaugaucgacgggugguacggcuaccaccaccagaacgagcaggggucgggcuacgccgcggaccagaaguccacccagaacgccaucaacgggaucaccaacaaggugaacagcgucaucgagaagaugaacacccaguucacggccgugggcaaggaguucaacaagcuggagaagcggauggagaaccucaacaagaagguggacgacggcuuccuggacaucuggaccuacaacgccgagcugcucguccugcuggagaacgagcgcacccucgacucccacgacagcaacgugaagaaccuguacgagaaggucaagucccagcugaagaacaacgccaaggagaucgggaacggcugcuucgaguucuaccacaagugcaacaacgagugcauggagucggugaagaacgggaccuacgacuacccgaaguacagcgaggaguccaagcucaaccgggagaagaucgacggcgugaagcuggagagcaugggggucuaccagauccuggcgaucuacuccacgguggccucgucccucgugcugcuggucagccucggcgccaucuccuucuggaugugcagcaacggcucccugcagugccgcaucugcaucuga

SEQ ID NO: 2258 - RNA, 1701 nt, Artificial Sequence
  derived and/or modified CDS sequence (AUadapt) from InfluenzaA__ABW38363__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucucggaggucgagggccgcauccaggaccuggagaaguacguggaggacaccaagaucgaccugugguccuacaacgccgagcucaucguggcccuggagaaccagcacacgaucgaccugaccgacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagucgggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 2259 - RNA, 1698 nt, Artificial Sequence
  derived and/or modified CDS sequence (AUadapt) from InfluenzaA__ABW39777__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggagaacuccuggcccaaccacaccgucaccggggugagcgccuccugcucgcacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugucgagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcgggcugggcuccggcaucaucacgagcaacgcccccauggacgagugcgacgcgaagugccagacgccccagggggccaucaacuccucgcugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacucggucaucgagaagaugaacacccaguucacggccguggggaaggaguucaacaagcucgagcggcgcauggagaaccugaacaagaaggucgacgacggcuuccuggacaucuggaccuacaacgccgagcuccuggugcugcucgagaacgagcggacccuggacuuccacgacuccaacgugaagaaccuguacgagaaggucaagagccagcucaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcuggagagcaugggcgucuaccagauccucgccaucuacuccacgguggccucgagccuggugcugcucgucucccugggggccaucagcuucuggaugugcuccaacggcagccugcagugccggaucugcaucuga

SEQ ID NO: 2260 - RNA, 1698 nt, Artificial Sequence; identical to SEQ ID NO: 2159
  derived and/or modified CDS sequence (AUadapt) from InfluenzaA__ABW39806__HA

SEQ ID NO: 2261 - RNA, 1698 nt, Artificial Sequence; identical to SEQ ID NO: 2166
  derived and/or modified CDS sequence (AUadapt) from InfluenzaA__ABW39817__HA

SEQ ID NO: 2262 - RNA, 1698 nt, Artificial Sequence
  derived and/or modified CDS sequence (AUadapt) from InfluenzaA__ABW39828__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucucguccgugagcuccuucgagcgguucgagaucuucccgaaggagagcuccuggcccaaccacacggucaccggggugagcgccuccugcucgcacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugucgagccacuacucccgcaaguucacgcccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucagccggggguucggcuccggcaucaucaacagcaacgcccccauggacgagugcgacgccaagugccagacgccccagggggcgaucaacuccucgcugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacuccaacgucaagaaccucuacgagaaggugaagaaccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgggagaagaucgacggcgucaagcucgagagcaugggcguguaccagauccuggcgaucuacuccaccguggccucgagccugguccuccuggugucccugggggccaucagcuucuggaugugcuccaacggcagccuccagugccgcaucugcaucuga

SEQ ID NO: 2263 - RNA, 1698 nt, Artificial Sequence
  derived and/or modified CDS sequence (AUadapt) from InfluenzaA__ABW39839__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacucgaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggccaacggcaaccugaucgcgccgcgguucgccuucgcccucagccgcggguucggcuccggcaucaucacgagcaacgcccccaugggggagugcgacgccaagugccagacgccccagggcgcgaucaacuccucgcugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugcgcaacggcaccuacgacuaccccaaguacucggaggaguccaagcucaaccgggagaagaucgacggcgugaagcuggagagcaugggggucuaccagauccuggcgaucuacagcacgguggccuccagccucgugcugcuggucucccucggcgccaucagcuucuggaugugcuccaacgggagccugcagugccgcaucugcaucuga

SEQ ID NO: 2264 - RNA, 1698 nt, Artificial Sequence
  derived and/or modified CDS sequence (AUadapt) from InfluenzaA__ABW39850__HA
augaaggugaagcugcucguccugcugugcaccuucaccgccacgaacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugucgucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcucgggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaaggggcagcugaagaacaacgcgaaggagaucggcaacgggugcuucgaguucuaccacaagugcaacgacgagugcauggaguccgugaagaacggcaccuacgacuaccccaaguacucggaggaguccaagcugaaccgcgagaagaucgacggcgugaagcucgagagcaugggggucuaccagauccuggccaucuacuccaccguggccagcucgcuggugcuccuggucucccugggcgccaucagcuucuggaugugcuccaacgggagccuccagugccggaucugcaucuga

SEQ ID NO: 2265 - RNA, 1698 nt, Artificial Sequence; identical to SEQ ID NO: 2190
  derived and/or modified CDS sequence (AUadapt) from InfluenzaA__ABW39861__HA

SEQ ID NO: 2266 - RNA, 1701 nt, Artificial Sequence; identical to SEQ ID NO: 2173
  derived and/or modified CDS sequence (AUadapt) from InfluenzaA__ABW39872__HA

SEQ ID NO: 2267 - RNA, 1698 nt, Artificial Sequence
  derived and/or modified CDS sequence (AUadapt) from InfluenzaA__ABW39883__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccccacaacaucggggaccagcgggcccuguaccacacggagaacgccuacgugucggucgugagcucccacuacagccgccgguucaccccggagaucgccaagcgccccaaggugcgggaccaggagggccgcaucaacuacuacuggacccuccuggagcccggggacaccaucaucuucgaggcgaacggcaaccugaucgcgccccgguucgccuucgcccucucccgcggguucggcagcggcaucaucacguccaacgccccgauggacgagugcgacgccaagugccagacgccccagggggccaucaacagcucccugcccuuccagaacguccaccccgugaccaucggcgagugcccgaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 2268 - RNA, 1698 nt, Artificial Sequence; identical to SEQ ID NO: 2200
  derived and/or modified CDS sequence (AUadapt) from InfluenzaA__ABW39894__HA

SEQ ID NO: 2269 - RNA, 1698 nt, Artificial Sequence; identical to SEQ ID NO: 2155
  derived and/or modified CDS sequence (AUadapt) from InfluenzaA__ABW39905__HA

SEQ ID NO: 2270 - RNA, 1698 nt, Artificial Sequence; identical to SEQ ID NO: 2159
  derived and/or modified CDS sequence (AUadapt) from InfluenzaA__ABW39927__HA

SEQ ID NO: 2271 - RNA, 1701 nt, Artificial Sequence
  derived and/or modified CDS sequence (AUadapt) from InfluenzaA__ABW39938__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacucguucuucucccgccugaacuggcugacgcaccucaaguucaaguaccccgcccugaacgugaccaugcccaacaacgagaaguucgacaagcuguacaucuggggcguccaccaccccgggaccgacaacgaccagaucuuccucuacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcugaucaacuccaccgggaaccucaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccucaaguccacccaggcggccaucgaccagaucaacgggaagcugaaccggcugaucggcaagaccaacgagaaguuccaccagaucgagaaggaguucucggaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgccuaccgcgacgaggcccugaacaaccgguuccagaucaagggggucgagcucaagucgggcuacaaggacuggauccuguggaucuccuucgccaucagcugcuuccugcucugcguggcccugcugggcuucaucaugugggcgugccagaaggggaacauccgcugcaacaucugcaucuga

SEQ ID NO: 2272 - RNA, 1698 nt, Artificial Sequence; identical to SEQ ID NO: 2159
  derived and/or modified CDS sequence (AUadapt) from InfluenzaA__ABW39949__HA

SEQ ID NO: 2273 - RNA, 1698 nt, Artificial Sequence; identical to SEQ ID NO: 2200
  derived and/or modified CDS sequence (AUadapt) from InfluenzaA__ABW39960__HA

SEQ ID NO: 2274 - RNA, 1698 nt, Artificial Sequence; identical to SEQ ID NO: 2155
  derived and/or modified CDS sequence (AUadapt) from InfluenzaA__ABW39982__HA

SEQ ID NO: 2275 - RNA, 1698 nt, Artificial Sequence; identical to SEQ ID NO: 2175
  derived and/or modified CDS sequence (AUadapt) from InfluenzaA__ABW39993__HA

SEQ ID NO: 2276 - RNA, 1698 nt, Artificial Sequence; identical to SEQ ID NO: 2155
  derived and/or modified CDS sequence (AUadapt) from InfluenzaA__ABW40004__HA

SEQ ID NO: 2277 - RNA, 1698 nt, Artificial Sequence; identical to SEQ ID NO: 2201
  derived and/or modified CDS sequence (AUadapt) from InfluenzaA__ABW40015__HA

SEQ ID NO: 2278 - RNA, 1701 nt, Artificial Sequence; identical to SEQ ID NO: 2232
  derived and/or modified CDS sequence (AUadapt) from InfluenzaA__ABW40026__HA

SEQ ID NO: 2279 - RNA, 1698 nt, Artificial Sequence; identical to SEQ ID NO: 2155
  derived and/or modified CDS sequence (AUadapt) from InfluenzaA__ABW40037__HA

SEQ ID NO: 2280 - RNA, 1698 nt, Artificial Sequence
  derived and/or modified CDS sequence (AUadapt) from InfluenzaA__ABW40048__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugucggucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucgaccaagcugcggauggucaccgggcuccgcaacauccccuccauccagagccggggccuguucggggccaucgccggcuucaucgagggcggguggaccggcaugguggacgggugguacggcuaccaccaccagaacgagaagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 2281 - RNA, 1698 nt, Artificial Sequence; identical to SEQ ID NO: 2159
  derived and/or modified CDS sequence (AUadapt) from InfluenzaA__ABW40059__HA

SEQ ID NO: 2282 - RNA, 1698 nt, Artificial Sequence
  derived and/or modified CDS sequence (AUadapt) from InfluenzaA__ABW40070__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucaagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugucgucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacucgaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggcgaucuacucgaccguggccuccagccuggugcuccuggucucccugggggccaucagcuucuggaugugcuccaacggcagccuccagugccggaucugcaucuga

SEQ ID NO: 2283 - RNA, 1701 nt, Artificial Sequence; identical to SEQ ID NO: 2173
  derived and/or modified CDS sequence (AUadapt) from InfluenzaA__ABW40081__HA

SEQ ID NO: 2284 - RNA, 1698 nt, Artificial Sequence
  derived and/or modified CDS sequence (AUadapt) from InfluenzaA__ABW40092__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucaagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagucgaagcucaaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 2285 - RNA, 1698 nt, Artificial Sequence; identical to SEQ ID NO: 2202
  derived and/or modified CDS sequence (AUadapt) from InfluenzaA__ABW40103__HA

SEQ ID NO: 2286 - RNA, 1698 nt, Artificial Sequence
  derived and/or modified CDS sequence (AUadapt) from InfluenzaA__ABW40114__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccaccagcugcucccacaacggcaagagcuccuucuaccgcaaccugcuguggcucacggggaagaacggccuguaccccaaccugagcaaguccuacgccaacaacaaggagaaggaggugcucgugcuguggggcguccaccacccgcccaacaucgggaaccagcgggcccuguaccacaccgagaacgccuacgugucgguggucagcucccacuacagccgccgguucacccccgagaucgccaagcgccccaaggugcgggaccaggagggccgcaucaacuacuacuggacccuccuggagcccggggacacgaucaucuucgaggccaacggcaaccugaucgcgccgcgguucgccuucgcccucucccgcggguucggcagcggcaucaucaccuccaacgcccccauggacgagugcgacgccaagugccagacgccccagggggcgaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgccgaccagaaguccacccagaacgcgaucaacggcaucacgaacaaggugaacagcgugaucgagaagaugaacacccaguucaccgccgucgggaaggaguucaacaagcuggagcggcgcauggagaaccucaacaagaagguggacgacggcuuccuggacaucuggaccuacaacgccgagcugcucguccugcuggagaacgagcggacgcucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcucaaccgcgagaagaucgacggcgugaagcuggaguccaugggcguguaccagauccuggccaucuacagcaccgucgcgagcucccucgugcugcuggugagccucggggccaucuccuucuggaugugcagcaacggcucccugcagugccggaucugcaucuga

SEQ ID NO: 2287 - RNA, 1698 nt, Artificial Sequence; identical to SEQ ID NO: 2155
  derived and/or modified CDS sequence (AUadapt) from InfluenzaA__ABW40125__HA

SEQ ID NO: 2288 - RNA, 1701 nt, Artificial Sequence; identical to SEQ ID NO: 2173
  derived and/or modified CDS sequence (AUadapt) from InfluenzaA__ABW40136__HA

SEQ ID NO: 2289 - RNA, 1698 nt, Artificial Sequence; identical to SEQ ID NO: 2190
  derived and/or modified CDS sequence (AUadapt) from InfluenzaA__ABW40147__HA

SEQ ID NO: 2290 - RNA, 1698 nt, Artificial Sequence; identical to SEQ ID NO: 2159
  derived and/or modified CDS sequence (AUadapt) from InfluenzaA__ABW40158__HA

SEQ ID NO: 2291 - RNA, 1698 nt, Artificial Sequence; identical to SEQ ID NO: 2159
  derived and/or modified CDS sequence (AUadapt) from InfluenzaA__ABW40180__HA

SEQ ID NO: 2292 - RNA, 1701 nt, Artificial Sequence; identical to SEQ ID NO: 2173
  derived and/or modified CDS sequence (AUadapt) from InfluenzaA__ABW40191__HA

SEQ ID NO: 2293 - RNA, 1698 nt, Artificial Sequence; identical to SEQ ID NO: 2175
  derived and/or modified CDS sequence (AUadapt) from InfluenzaA__ABW40202__HA

SEQ ID NO: 2294 - RNA, 1698 nt, Artificial Sequence; identical to SEQ ID NO: 2155
  derived and/or modified CDS sequence (AUadapt) from InfluenzaA__ABW40213__HA

SEQ ID NO: 2295 - RNA, 1698 nt, Artificial Sequence; identical to SEQ ID NO: 2155
  derived and/or modified CDS sequence (AUadapt) from InfluenzaA__ABW40224__HA

SEQ ID NO: 2296 - RNA, 1698 nt, Artificial Sequence; identical to SEQ ID NO: 2159
  derived and/or modified CDS sequence (AUadapt) from InfluenzaA__ABW40235__HA

SEQ ID NO: 2297 - RNA, 1701 nt, Artificial Sequence
  derived and/or modified CDS sequence (AUadapt) from InfluenzaA__ABW40246__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagguguuccuguacgcgcaggccagcgggcggaucaccguguccacgaagcgcucgcagcagaccgucaucccgaacaucggcagccggccccgcgugcggaacauccccucccgcaucucgaucuacuggaccaucgugaagcccggcgacauccugcucaucaacuccaccgggaaccugaucgccccgcggggcuacuuccgcauccggagcgggaaguccucgaucaugcgcuccgacgcccccaucggcaagugcaacagcgagugcaucacgcccaacggcuccauccccaacgacaagccguuccagaacgucaaccggaucaccuacggggccugcccccgcuacgugaagcagaacacccugaagcucgcgaccggcaugcggaacgugcccgagaagcagacgcgcgggaucuucggcgccaucgccggguucaucgagaacggcugggagggcauggucgacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 2298 - RNA, 1698 nt, Artificial Sequence
  derived and/or modified CDS sequence (AUadapt) from InfluenzaA__ABW40257__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcaucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgucaagcuggaguccaugggcguguaccagauccuggcgaucuacagcaccguggccagcucccucguccugcuggugagccucggggccaucuccuucuggaugugcagcaacggcucccugcagugccggaucugcaucuga

SEQ ID NO: 2299 - RNA, 1701 nt, Artificial Sequence; identical to SEQ ID NO: 2232
  derived and/or modified CDS sequence (AUadapt) from InfluenzaA__ABW40268__HA

SEQ ID NO: 2300 - RNA, 1698 nt, Artificial Sequence
  derived and/or modified CDS sequence (AUadapt) from InfluenzaA__ABW40312__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggccgcagcuccuucuaccggaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacgccuacgugucggucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucgaccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 2301 - RNA, 1701 nt, Artificial Sequence; identical to SEQ ID NO: 2173
  derived and/or modified CDS sequence (AUadapt) from InfluenzaA__ABW40323__HA

SEQ ID NO: 2302 - RNA, 1698 nt, Artificial Sequence; identical to SEQ ID NO: 2201
  derived and/or modified CDS sequence (AUadapt) from InfluenzaA__ABW40334__HA

SEQ ID NO: 2303 - RNA, 1698 nt, Artificial Sequence; identical to SEQ ID NO: 2201
  derived and/or modified CDS sequence (AUadapt) from InfluenzaA__ABW40345__HA

SEQ ID NO: 2304 - RNA, 1698 nt, Artificial Sequence
  derived and/or modified CDS sequence (AUadapt) from InfluenzaA__ABW40356__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucgucauguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccugcucgagcccggggacaccaucaucuucgaggcgaacggcaaccugaucgccccgcgguucgccuucgcccugucccgcggguucggcagcggcaucaucacguccaacgcccccaugggggagugcgacgcgaagugccagacgccccagggcgccaucaacagcucccuccccuuccagaacguccacccggugaccaucggggagugccccaaguacgugcggucggccaagcugcgcauggucaccggccugcggaacauccccuccauccagagccgcggccucuucggggccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccugaacaagaaggucgacgacggguuccucgacaucuggaccuacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcugaaccgcgagaagaucgacggcgugaagcucgaguccaugggggucuaccagauccuggccaucuacagcacgguggccagcucccuggugcuccuggucagccugggcgccaucuccuucuggaugugcagcaacgggucccuccagugccggaucugcaucuga

SEQ ID NO: 2305 - RNA, 1698 nt, Artificial Sequence; identical to SEQ ID NO: 2159
  derived and/or modified CDS sequence (AUadapt) from InfluenzaA__ABW40367__HA

SEQ ID NO: 2306 - RNA, 1701 nt, Artificial Sequence; identical to SEQ ID NO: 2173
  derived and/or modified CDS sequence (AUadapt) from InfluenzaA__ABW40378__HA

SEQ ID NO: 2307 - RNA, 1698 nt, Artificial Sequence; identical to SEQ ID NO: 2159
  derived and/or modified CDS sequence (AUadapt) from InfluenzaA__ABW40389__HA

SEQ ID NO: 2308 - RNA, 1698 nt, Artificial Sequence; identical to SEQ ID NO: 2155
  derived and/or modified CDS sequence (AUadapt) from InfluenzaA__ABW40400__HA

SEQ ID NO: 2309 - RNA, 1698 nt, Artificial Sequence; identical to SEQ ID NO: 2155
  derived and/or modified CDS sequence (AUadapt) from InfluenzaA__ABW40411__HA

SEQ ID NO: 2310 - RNA, 1698 nt, Artificial Sequence; identical to SEQ ID NO: 2155
  derived and/or modified CDS sequence (AUadapt) from InfluenzaA__ABW40422__HA

SEQ ID NO: 2311 - RNA, 1698 nt, Artificial Sequence; identical to SEQ ID NO: 2201
  derived and/or modified CDS sequence (AUadapt) from InfluenzaA__ABW40433__HA

SEQ ID NO: 2312 - RNA, 1698 nt, Artificial Sequence; identical to SEQ ID NO: 2175
  derived and/or modified CDS sequence (AUadapt) from InfluenzaA__ABW40444__HA

SEQ ID NO: 2313 - RNA, 1698 nt, Artificial Sequence; identical to SEQ ID NO: 2192
  derived and/or modified CDS sequence (AUadapt) from InfluenzaA__ABW40455__HA

SEQ ID NO: 2314 - RNA, 1698 nt, Artificial Sequence; identical to SEQ ID NO: 2159
  derived and/or modified CDS sequence (AUadapt) from InfluenzaA__ABW40466__HA

SEQ ID NO: 2315 - RNA, 1698 nt, Artificial Sequence; identical to SEQ ID NO: 2159
  derived and/or modified CDS sequence (AUadapt) from InfluenzaA__ABW40477__HA

SEQ ID NO: 2316 - RNA, 1698 nt, Artificial Sequence; identical to SEQ ID NO: 2155
  derived and/or modified CDS sequence (AUadapt) from InfluenzaA__ABW40488__HA

SEQ ID NO: 2317 - RNA, 1698 nt, Artificial Sequence; identical to SEQ ID NO: 2159
  derived and/or modified CDS sequence (AUadapt) from InfluenzaA__ABW40499__HA

SEQ ID NO: 2318 - RNA, 1698 nt, Artificial Sequence; identical to SEQ ID NO: 2201
  derived and/or modified CDS sequence (AUadapt) from InfluenzaA__ABW40510__HA

SEQ ID NO: 2319 - RNA, 1698 nt, Artificial Sequence; identical to SEQ ID NO: 2155
  derived and/or modified CDS sequence (AUadapt) from InfluenzaA__ABW40521__HA

SEQ ID NO: 2320 - RNA, 1698 nt, Artificial Sequence; identical to SEQ ID NO: 2159
  derived and/or modified CDS sequence (AUadapt) from InfluenzaA__ABW40532__HA

SEQ ID NO: 2321 - RNA, 1698 nt, Artificial Sequence
  derived and/or modified CDS sequence (AUadapt) from InfluenzaA__ABW40543__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaccuccaaggagagcugguccuacaucguggagacgcccaaccccgagaacgggaccugcuaccccggcuacuucgccgacuacgaggagcugcgggagcagcucucguccgugagcuccuucgagcgcuucgagaucuucccgaaggagagcuccuggcccaaccacaccgucaccggggugagcgccuccugcucgcacaacggcaaguccagcuucuaccggaaccugcuguggcucacggggaagaacggccuguaccccaaccuguccaagagcuacgccaacaacaaggagaaggaggugcucguccuguggggcgugcaccacccgcccaacaucggcgaccagcgcgcccuguaccacaccgagaacgccuacguguccgucgugucgagccacuacucccggcgcuucacccccgagaucgccaagcggcccaaggugcgcgaccaggagggccggaucaacuacuacuggacccuccuggagcccggggacacgaucaucuucgaggcgaacggcaaccugaucgccccgcgcuucgccuucgcccucagccggggguucggcuccggcaucaucaccagcaacgcccccauggacgagugcgacgcgaagugccagacgccccagggggccaucaacuccucgcugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacucggucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggacguacgacuaccccaaguacagcgaggaguccaagcucaaccgggagaagaucgacggcgugaagcuggagagcaugggcgucuaccagauccuggccaucuacuccaccguggccucgagccucgugcugcuggucucccucggggccaucagcuucuggaugugcuccaacggcagccugcagugccgcaucugcaucuga

SEQ ID NO: 2322 - RNA, 1698 nt, Artificial Sequence; identical to SEQ ID NO: 2300
  derived and/or modified CDS sequence (AUadapt) from InfluenzaA__ABW40554__HA

SEQ ID NO: 2323 - RNA, 1698 nt, Artificial Sequence; identical to SEQ ID NO: 2159
  derived and/or modified CDS sequence (AUadapt) from InfluenzaA__ABW40565__HA

SEQ ID NO: 2324 - RNA, 1698 nt, Artificial Sequence
  derived and/or modified CDS sequence (AUadapt) from InfluenzaA__ABW40576__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgugaccggggucuccgccagcugcucccacaacggcaagucguccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacaccuacgugagcguggucagcucccacuacucgcgccgguucacccccgagaucgccaagcgccccaaggugcgggaccaggagggccgcaucaacuacuacuggacccuccuggagcccggggacacgaucauccuggaggccaacggcaaccucaucgcgccgcgguucgccuucgcccugucccgcggguucggcagcggcaucaucaccuccaacgcccccauggacgagugcgacgccaagugccagacgccccagggggcgaucaacagcucccugcccuuccagaacgugcacccggucaccaucggcgagugccccaaguacgugcggagcaccaagcuccgcauggugaccgggcugcggaacauccccuccauccagucgcgcggccuguucggggccaucgccggcuucaucgagggcggguggaccggcauggucgacgggugguacggcuaccaccaccagaacgagcagggguccggcuacgccgccgaccagaaguccacccagaacgcgaucaacggcaucacgaacaaggugaacagcgugaucgagaagaugaacacccaguucaccgccgucgggaaggaguucaacaagcucgagcggcgcauggagaaccugaacaagaagguggacgacggcuuccuggacaucuggaccuacaacgccgagcuccugguccugcucgagaacgagcggacgcuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagucgaagcugaaccgcgagaagaucgacggcgugaagcuggaguccaugggcguguaccagauccucgccaucuacagcaccgucgcgagcucccuggugcugcucgugagccugggggccaucuccuucuggaugugcagcaacggcucccugcagugccggaucugcaucuga

SEQ ID NO: 2325 - RNA, 1701 nt, Artificial Sequence; identical to SEQ ID NO: 2232
  derived and/or modified CDS sequence (AUadapt) from InfluenzaA__ABW40587__HA

SEQ ID NO: 2326 - RNA, 1698 nt, Artificial Sequence; identical to SEQ ID NO: 2201
  derived and/or modified CDS sequence (AUadapt) from InfluenzaA__ABW40598__HA

SEQ ID NO: 2327 - RNA, 1698 nt, Artificial Sequence; identical to SEQ ID NO: 2175
  derived and/or modified CDS sequence (AUadapt) from InfluenzaA__ABW40609__HA

SEQ ID NO: 2328 - RNA, 1698 nt, Artificial Sequence; identical to SEQ ID NO: 2190
  derived and/or modified CDS sequence (AUadapt) from InfluenzaA__ABW40620__HA

SEQ ID NO: 2329 - RNA, 1701 nt, Artificial Sequence; identical to SEQ ID NO: 2232
  derived and/or modified CDS sequence (AUadapt) from InfluenzaA__ABW40631__HA

SEQ ID NO: 2330 - RNA, 1698 nt, Artificial Sequence; identical to SEQ ID NO: 2155
  derived and/or modified CDS sequence (AUadapt) from InfluenzaA__ABW40642__HA

SEQ ID NO: 2331 - RNA, 1701 nt, Artificial Sequence; identical to SEQ ID NO: 2232
  derived and/or modified CDS sequence (AUadapt) from InfluenzaA__ABW40653__HA

SEQ ID NO: 2332 - RNA, 1698 nt, Artificial Sequence; identical to SEQ ID NO: 2201
  derived and/or modified CDS sequence (AUadapt) from InfluenzaA__ABW40664__HA

SEQ ID NO: 2333 - RNA, 1698 nt, Artificial Sequence; identical to SEQ ID NO: 2175
  derived and/or modified CDS sequence (AUadapt) from InfluenzaA__ABW40675__HA

SEQ ID NO: 2334 - RNA, 1698 nt, Artificial Sequence; identical to SEQ ID NO: 2304
  derived and/or modified CDS sequence (AUadapt) from InfluenzaA__ABW71294__HA

SEQ ID NO: 2335 - RNA, 1698 nt, Artificial Sequence; identical to SEQ ID NO: 2201
  derived and/or modified CDS sequence (AUadapt) from InfluenzaA__ABW71305__HA

SEQ ID NO: 2336 - RNA, 1698 nt, Artificial Sequence
  derived and/or modified CDS sequence (AUadapt) from InfluenzaA__ABW71316__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagccccgggacaccaucaucuucgaggcgaacgggaaccugaucgccccgcgcuucgccuucgcccucucccggggcuucgggagcggcaucaucacguccaacgcccccauggacgagugcgacgcgaagugccagacgccccagggcgccaucaacagcucccugcccuuccagaacgugcacccggucaccaucggggagugccccaaguacgugcgcucgaccaagcugcggauggugaccggccuccgcaacauccccuccauccagagccgggggcuguucggcgccaucgccggguucaucgagggcggcuggaccgggauggucgacggcugguacggguaccaccaccagaacgagcagggcuccggguacgccgcggaccagaaguccacccagaacgccaucaacggcaucaccaacaaggugaacagcgugaucgagaagaugaacacgcaguucaccgccgucggcaaggaguucaacaagcuggagcgccggauggagaaccucaacaagaagguggacgacggguuccuggacaucuggaccuacaacgccgagcugcucguccugcuggagaacgagcgcacccucgacuuccacgacagcaacgugaagaaccuguacgagaaggugaagucccagcugaagaacaacgccaaggagaucggcaacgggugcuucgaguucuaccacaagugcaacgacgagugcauggagagcgucaagaacggcacguacgacuaccccaaguacuccgaggagucgaagcucaaccgggagaagaucgacggggugaagcuggaguccaugggcguguaccagauccuggcgaucuacagcaccgucgccagcucccucgugcugcuggugagccucggcgccaucuccuucuggaugugcagcaacgggucccugcagugccgcaucugcaucuga

SEQ ID NO: 2337 - RNA, 1698 nt, Artificial Sequence; identical to SEQ ID NO: 2155
  derived and/or modified CDS sequence (AUadapt) from InfluenzaA__ABW71327__HA

SEQ ID NO: 2338 - RNA, 1698 nt, Artificial Sequence; identical to SEQ ID NO: 2159
  derived and/or modified CDS sequence (AUadapt) from InfluenzaA__ABW71338__HA

SEQ ID NO: 2339 - RNA, 1701 nt, Artificial Sequence; identical to SEQ ID NO: 2173
  derived and/or modified CDS sequence (AUadapt) from InfluenzaA__ABW71349__HA

SEQ ID NO: 2340 - RNA, 1698 nt, Artificial Sequence
  derived and/or modified CDS sequence (AUadapt) from InfluenzaA__ABW71360__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugucguccuucgagcgcuucgagaucuucccgaaggagagcuccuggcccaaccacaccgucaccggggugagcgccuccugcagccacaacggcaaguccucguucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcgacgacgagugcauggaguccgugaagaacgggaccuacgacuaccccaaguacagcgaggaguccaagcucaaccgcgagaagaucgacggcgugaagcuggagucgaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 2341 - RNA, 1698 nt, Artificial Sequence; identical to SEQ ID NO: 2175
  derived and/or modified CDS sequence (AUadapt) from InfluenzaA__ABW71371__HA

SEQ ID NO: 2342 - RNA, 1698 nt, Artificial Sequence
  derived and/or modified CDS sequence (AUadapt) from InfluenzaA__ABW71382__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcugguccaaccacaccaucaccggggugagcgccuccugcagccacaacggcaaguccagcuucuaccgcaaccugcuguggcucaccgggaagaacggccuguaccccaaccuguccaagucguacgccaacaacaaggagaaggagguccucgugcuguggggcgugcaccacccgcccaacaucggggaccagcgggcccuguaccacacggagaacgccuacgucagcgugguguccagccacuacucccgccgguucacccccgagaucgccaagcgccccaagguccgggaccaggagggccgcaucaacuacuacuggacccuccuggagcccggggacaccaucaucuucgaggcgaacggcaaccugaucgcgccccgguucgccuucgcccucagccgcggguucggcuccggcaucaucacgagcaacgccccgauggacgagugcgacgccaagugccagacgccccagggggccaucaacuccucgcugcccuuccagaacgugcaccccgugaccaucggcgagugcccgaaguacguccgguccaccaagcugcgcauggugaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacucggaggaguccaagcucaaccgcgagaagaucgacggcgugaagcuggagagcaugggcguguaccagauccuggcgaucuacagcaccguggccuccagccucguccugcuggugucccucggggccaucagcuucuggaugugcuccaacggcagccugcagugccggaucugcaucuga

SEQ ID NO: 2343 - RNA, 1698 nt, Artificial Sequence
  derived and/or modified CDS sequence (AUadapt) from InfluenzaA__ABW71393__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucaccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucacggggaagaacggccuguaccccaaccugagcaaguccuacgccaacaacaaggagaaggaggugcucguccuguggggcgugcaccacccgcccaacaucggggaccagcgggcccuguaccacaccgagaacgccuacgugucggucgugagcucccacuacagccgccgguucacccccgagaucgccaagcgccccaaggugcgggaccaggagggccgcaucaacuacuacuggacccuccuggagcccggggacacgaucaucuucgaggccaacggcaaccugaucgcgccgcgguucgccuucgcccucucccgcggguucggcagcggcaucaucaccuccaacgcccccaugggggagugcgacgccaagugccagacgccccagggcgcgaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgccaaggagaucggcaacgggugcuucgaguucuaccacaagugcaacgacgagugcauggagagcgugaagaacggcacguacgacuaccccaaguacuccgaggagucgaagcucaaccgcgagaagaucgacggcgugaagcuggaguccaugggggucuaccagauccuggcgaucuacagcaccguggccagcucccucgugcugcuggucagccucggcgccaucuccuucuggaugugcagcaacgggucccugcagugccggaucugcaucuga

SEQ ID NO: 2344 - RNA, 1698 nt, Artificial Sequence; identical to SEQ ID NO: 2304
  derived and/or modified CDS sequence (AUadapt) from InfluenzaA__ABW71404__HA

SEQ ID NO: 2345 - RNA, 1698 nt, Artificial Sequence; identical to SEQ ID NO: 2192
  derived and/or modified CDS sequence (AUadapt) from InfluenzaA__ABW71415__HA

SEQ ID NO: 2346 - RNA, 1698 nt, Artificial Sequence
  derived and/or modified CDS sequence (AUadapt) from InfluenzaA__ABW71426__HA
augaaggccaagcugcucauccugcugugcaccuucaccgccacguacgcggacaccaucugcaucggcuaccacgccaacaacucgaccgacaccguggacacgguccucgagaagaacgugaccgugacccacuccgucaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucggucuccagcuucgagcgguucgagaucuucccgaaggaguccagcuggcccaaccacaccgugaccgggguguccgccagcugcucccacaacggcaagucguccuucuaccgcaaccugcuguggcucaccgggaagaacggccuguaccccaaccugagcaaguccuacgccaacaacaaggagaaggagguccucgugcuguggggcgugcaccacccgcccaacaucggggaccagcgggcccuguaccacacggagaacgccuacgucagcguggugagcucccacuacucgcgccgguucacccccgagaucgcgaagcgccccaagguccgggaccaggagggccgcaucaacuacuacuggacccuccuggagcccggggacaccaucaucuucgaggccaacggcaaccugaucgccccgcgguucgccuucgcccucucccgcggguucggcagcggcaucaucacguccaacgcgcccauggacgagugcgacgccaagugccagacgccccagggggccaucaacagcucccugcccuuccagaacgugcacccggugaccaucggcgagugccccaaguacguccggagcaccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgcgaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgucaagcuggaguccaugggcguguaccagauccuggccaucuacagcaccguggccagcucccucguccugcuggugagccucggggccaucuccuucuggaugugcagcaacggcucccugcagugccggaucugcaucuga

SEQ ID NO: 2347 - RNA, 1698 nt, Artificial Sequence
  derived and/or modified CDS sequence (AUadapt) from InfluenzaA__ABW71448__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucgaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgugaagcuggaguccaugggcgucuaccagauccuggcgaucuacagcaccaucgccagcucccucgugcugcuggugagccucggggccaucuccuucuggaugugcagcaacggcucccugcagugccggaucugcaucuga

SEQ ID NO: 2348 - RNA, 1698 nt, Artificial Sequence; identical to SEQ ID NO: 2175
  derived and/or modified CDS sequence (AUadapt) from InfluenzaA__ABW71459__HA

SEQ ID NO: 2349 - RNA, 1698 nt, Artificial Sequence; identical to SEQ ID NO: 2159
  derived and/or modified CDS sequence (AUadapt) from InfluenzaA__ABW71470__HA

SEQ ID NO: 2350 - RNA, 1707 nt, Artificial Sequence
  derived and/or modified CDS sequence (AUadapt) from InfluenzaA__ABW74702__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccucguccggcgucagcuccgccugccccuaccugggcucguccagcuucuuccgcaacgugguguggcucaucaagaagaacuccacguaccccaccaucaagaaguccuacaacaacaccaaccaggaggaccugcugguccucugggggauccaccaccccaacgacgcggccgagcagacccggcuguaccagaacccgacgaccuacaucagcaucggcaccucgacccugaaccagcgccucgugcccaagaucgccacgcggagcaaggugaacgggcaguccggccgcauggaguucuucuggaccauccugaagcccaacgacgccaucaacuucgagucgaacgggaacuucaucgcgcccgaguacgccuacaagaucgucaagaagggcgacuccgccaucaugaaguccgagcuggaguacggcaacugcaacaccaagugccagaccccgaugggggccaucaacagcagcaugcccuuccacaacauccacccccucacgaucggcgagugccccaaguacgugaaguccaaccggcuggugcuggccaccgggcuccgcaacucgccgcagcgggagucccgccggaagaagcgcggccuguucggcgcgaucgccggguucaucgagggcggguggcagggcauggucgacgggugguacggcuaccaccacagcaacgagcagggcuccggguacgccgccgacaaggagucgacccagaaggccaucgacggcgugaccaacaaggugaacuccaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucgggaacggcugcuucgaguucuaccacaagugcgacaacgagugcaucgaguccauccggaacggcaccuacaacuacccccaguacagcgaggaggcccgccugaagcgggaggagaucuccggggucaagcuggagucgaucggcacguaccagauccucuccaucuacagcaccguggccucgucccuggcgcuggccaucaugauggccgggcucagccuguggaugugcuccaacggcagccugcagugccgcaucugcaucuga

SEQ ID NO: 2351 - RNA, 1707 nt, Artificial Sequence
  derived and/or modified CDS sequence (AUadapt) from InfluenzaA__ABW74703__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugaaggacugcuccgucgccggguggcugcucggcaacccgaugugcgacgaguucaucaacgugcccgaguggucguacaucguggagaaggccaaccccaccaacgaccugugcuaccccggguccuucaacgacuacgaggagcugaagcaccuccugagccgcaucaaccacuucgagaagauccagaucaucccgaaguccagcugguccgaccacgaggccucguccggcgucagcuccgccugccccuaccugggcucgcccuccuucuuccggaacgugguguggcucaucaagaagaacagcacguaccccaccaucaagaaguccuacaacaacaccaaccaggaggaccugcugguccucugggggauccaccacccgaacgacgcggccgagcagacccgccuguaccagaaccccacgaccuacaucagcaucggcaccuccacccugaaccagcggcucgugcccaagaucgccacgcgcucgaaggugaacgggcagagcggccggauggaguucuucuggaccauccugaagcccaacgacgccgucaacuucgaguccaacgggaacuucaucgcgccggaguacgccuacaagaucgugaagaagggcgacucggccaucaugaaguccgagcuggaguacggcaacugcaacaccaagugccagacccccaugggggccaucaacagcuccaugcccuuccacaacauccacccccucacgaucggcgagugcccgaaguacgugaaguccaaccgccugguccuggccaccgggcuccggaacagcccccagcgcgagucgcggcgcaagaagcggggccuguucggcgcgaucgccggguucaucgagggcggguggcagggcaugguggacgggugguacggcuaccaccacuccaacgagcagggcagcggguacgccgccgacaaggaguccacccagaaggccaucgacggcgugaccaacaaggucaacucgaucaucgacaagaugaacacgcaguucgaggcgguggggcgcgaguucaacucccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccacaagugcgacaacgagugcauggaguccauccgcaacggcaccuacaacuacccccaguacagcgaggaggcccggcugaagcgcgaggagaucuccggggugaagcuggagucgaucggcacguaccagauccucuccaucuacagcaccguggccucgucccuggcgcuggccaucaugaucgccgggcucagccuguggaugugcuccaacggcagccugcagugccggaucugcaucuga

SEQ ID NO: 2352 - RNA, 1707 nt, Artificial Sequence
  derived and/or modified CDS sequence (AUadapt) from InfluenzaA__ABW74705__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccaccaacgaccugugcuaccccggguccuucaacgacuacgaggagcugaagcaccuccugagccggaucaaccacuucgagaagauccagaucaucccgaaguccucgugguccgaccacgaggccagcuccggcgucagcuccgccugccccuaccugggcucgcccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucucgaucggcaccuccacccugaaccagcgccucgugcccaagaucgccacgcggagcaaggugaacgggcagagcggccgcauggaguucuucuggaccauccugaagcccaacgacgccaucaacuucgaguccaacgggaacuucaucgcgccggaguacgccuacaagaucgucaagaagggcgacucggccaucaugaaguccgagcuggaguacggcaacugcaacaccaagugccagacccccaugggggccaucaacagcuccaugcccuuccacaacauccacccccucacgaucggcgagugcccgaaguacgugaaguccaaccggcuggugcuggccaccgggcuccgcaacucgccccagcgggagagccgccggaagaagcgcggccuguucggcgcgaucgccggguucaucgagggcggguggcagggcauggucgacgggugguacggcuaccaccacuccaacgagcagggcucgggguacgccgccgacaaggaguccacccagaaggccaucgacggcgugaccaacaaggugaacagcaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucucgggggucaagcuggaguccaucggcacguaccagauccucagcaucuacuccaccguggccucgagccuggcgcuggccaucaugaucgccgggcucucccuguggaugugcagcaacggcucccugcagugccgcaucugcaucuga

SEQ ID NO: 2353 - RNA, 1707 nt, Artificial Sequence
  derived and/or modified CDS sequence (AUadapt) from InfluenzaA__ABW74707__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccaccaacgaccugugcuaccccggguccuucaacgacuacgaggagcugaagcaccuccugagccggaucaaccacuucgagaagauccagaucaucccgaaguccucgugguccgaccacgaggccagcuccggcgucagcuccgccugccccuaccugggcucgcccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucucgaucggcaccuccacccugaaccagcgccucgugcccaagauggccacgcggagcaaggugaacgggcagagcggccgcauggaguucuucuggaccauccugaagcccaacgacgccaucaacuucgaguccaacgggaacuucaucgcgccggaguacgccuacaagaucgucaagaagggcgacucggccaucaugaaguccgagcuggaguacggcaacugcaacaccaagugccagacccccaugggggccaucaacagcuccaugcccuuccacaacauccacccccucacgaucggcgagugcccgaaguacgugaaguccaaccggcuggugcuggccaccgggcuccgcaacucgccccagcgggagagccgccggaagaagcgcggccuguucggcgcgaucgccggguucaucgagggcggguggcagggcauggucgacgggugguacggcuaccaccacuccaacgagcagggcucgggguacgccgccgacaaggaguccacccagaaggccaucgacggcgugaccaacaaggugaacagcaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucucgggggucaagcuggaguccaucggcacguaccagauccucagcaucuacuccaccguggccucgagccuggcgcuggccaucaugaucgccgggcucucccuguggaugugcagcaacggcucccugcagugccgcaucugcaucuga

SEQ ID NO: 2354 - RNA, 1707 nt, Artificial Sequence
  derived and/or modified CDS sequence (AUadapt) from InfluenzaA__ABW74708__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccaccaacgaccugugcuaccccggguccuucaacgacuacgaggagcugaagcaccuccugagccggaucaaccacuucgagaagauccagaucaucccgaaguccucgugguccgaccacgaggccagcuccggcgucucguccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucucgaucggcaccuccacccugaaccagcgccucgugcccaagaucgccacgcggagcaaggugaacgggcagucgggccgcauggaguucuucuggaccauccugaagcccaacgacgccaucaacuucgaguccaacgggaacuucaucgcgccggaguacgccuacaagaucgucaagaagggcgacagcgccaucaugaaguccgagcuggaguacggcaacugcaacaccaagugccagacccccaugggggccaucaacucguccaugcccuuccacaacauccacccccucacgaucggcgagugcccgaaguacgucaagagcaaccgguccgugcuggccaccgggcugcgcaacucgccccagcgggagucccgccggaagaagcgcggccucuucggcgcgaucgccggguucaucgagggcggguggcagggcaugguggacgggugguacggcuaccaccacagcaacgagcagggcuccggguacgccgccgacaaggagagcacccagaaggccaucgacggcgugaccaacaaggugaacuccaucaucgacaagaugaacacgcaguucgaggcggucgggcgggaguucaacaaccuggagcgccggaucgagaaccugaacaagaagauggaggacggcuuccucgacguguggaccuacaacgccgagcugcuggugcucauggagaacgagcgcacccuggacuuccacgacucgaacgucaagaaccuguacgacaaggugcggcuccagcugcgcgacaacgccaaggagcuggggaacggcugcuucgaguucuaccacaagugcgacaacgagugcauggaguccauccggaacggcaccuacaacuacccccaguacagcgaggaggcccgccucaagcgggaggagaucuccggggucaagcuggagucgaucggcacguaccagauccuguccaucuacagcaccguggccucgucccucgcgcuggccaucaugauggccgggcugagccucuggaugugcuccaacggcagccugcagugccgcaucugcaucuga

SEQ ID NO: 2355 - RNA, 1707 nt, Artificial Sequence; identical to SEQ ID NO: 2352
  derived and/or modified CDS sequence (AUadapt) from InfluenzaA__ABW74710__HA

SEQ ID NO: 2356 - RNA, 1707 nt, Artificial Sequence; identical to SEQ ID NO: 2352
  derived and/or modified CDS sequence (AUadapt) from InfluenzaA__ABW74711__HA

SEQ ID NO: 2357 - RNA, 1707 nt, Artificial Sequence
  derived and/or modified CDS sequence (AUadapt) from InfluenzaA__ABW74712__HA
auggagaagaucgugcugcuccugucgaucgucucccuggucaagagcgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugcgcgacugcucgguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccggaucaaccacuucgagaagauccagaucauccccaagagcuccuggucggaccacgaggccuccagcggcgucuccagcgccugcccguaccugggcucccccucguucuuccgcaacgugguguggcucaucaagaagaacuccacguaccccaccaucaagaaguccuacaacaacaccaaccaggaggaccugcugguccucugggggauccaccacccgaacaacgaggaggagcagacccggcuguaccagaaccccacgaccuacaucagcaucggcaccagcacccugaaccagcgccucgugcccaagaucgccacgcggucgaaggugaacgggcaguccggccgcauggaguucuucuggaccauccugaagcccaacgacgcgaucaacuucgagagcaacgggaacuucaucgccccggaguacgccuacaagaucgucaagaagggcgacuccgccaucaugaaguccgagcuggaguacagcaacugcaacaccaagugccagacccccaugggcgcgaucaacucguccaugcccuuccacaacauccacccccucacgaucggggagugcccgaaguacgucaagagcucccggcuggugcuggccaccggccuccgcaacagcccccagcgggagucccgccggaagaagcgcgggcuguucggcgccaucgccggcuucaucgagggcggguggcaggggaugguggacggcugguacggguaccaccacucgaacgagcagggcuccggcuacgccgcggacaaggagagcacccagaaggccaucgacggggugaccaacaaggugaacuccaucaucgacaagaugaacacgcaguucgaggccgucggccgggaguucaacaaccuggagcgccggaucgagaaccucaacaagaagauggaggacggguuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucggcaacgggugcuucgaguucuaccacaagugcgacaacgagugcauggaguccauccggaacggcaccuacaacuacccccaguacucggaggaggcgcgccugaagcgggaggagaucuccggcgucaagcuggagagcaucgggacguaccagauccucagcaucuacuccaccguggccucgucccuggcccuggccaucaugaucgccggccucagccuguggaugugcuccaacgggagccugcagugccgcaucugcaucuga

SEQ ID NO: 2358 - RNA, 1701 nt, Artificial Sequence
  derived and/or modified CDS sequence (AUadapt) from InfluenzaA__ABW80976__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccucccgcaucugcgacagcccccaccagauccuggacggggagaacugcacccugaucgacgcccuccugggcgacccccacugcgacggguuccagaacaaggagugggaccuguucguggagcgguccaaggccuacucgaacugcuaccccuacgacgugccggacuacgucucccuccgcagccugguggcguccucgggcacgcuggaguucaacaacgaguccuucaacuggaccggcguggcccagaacgggaccagcuccgccugcaagcggcgcucggacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucucgaucuacgcgcaggccagcggccgcgugaccgucuccaccaagcggucgcagcagaccgugaucccgaacaucgggucccgccccugggugcggggcgucagcuccggcaucucgaucuacuggacgaucgugaagcccggggacauccugcucaucaacuccaccggcaaccugaucgcgccccgcggguacuucaagauccggagcggcaaguccucgaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcugaagcucgccaccgggaugcggaacgugcccgagaagcagacccgcggcaucuucggggccaucgccggcuucaucgagaacggcugggaggggaugauggacggcugguacggguuccggcaccagaacucggagggcaccgggcaggccgccgaccugaaguccacgcaggcggccaucaaccagaucaacggcaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagcgcaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcucaagagcggcuacaaggacuggauccuguggaucagcuucgccaucuccugcuuccugcugugcaucgugcugcucggcuucaucaugugggccugccagaaggggaacauccgcugcaacaucugcaucuga

SEQ ID NO: 2359 - RNA, 1701 nt, Artificial Sequence
  derived and/or modified CDS sequence (AUadapt) from InfluenzaA__ABW80977__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaagucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucaaccuguacgcgcaggccucgggccggaucaccguguccacgaagcgcagccagcagaccgugaucccgaacaucggcucgcggccccgcguccgggacgugcccucccgcaucucgaucuacuggaccaucgugaagcccggggacauccugcucaucuccagcaccggcaaccugaucgccccgcggggguacuucaagauccgcuccggcaagucguccaucaugcggucggacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggucguacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 2360 - RNA, 1698 nt, Artificial Sequence
  derived and/or modified CDS sequence (AUadapt) from InfluenzaA__ABW80979__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgugaacaacaaggagaaggaggugcucguccuguggggcgugcaccacccgcccaacaucgggaaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 2361 - RNA, 1701 nt, Artificial Sequence
  derived and/or modified CDS sequence (AUadapt) from InfluenzaA__ABW81505__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagucgugguccuacaucgccgagacgcccaaccccaagaacgggaccugcuaccccggcuacuucgccgacuacgaggagcuccgggagcagcugagcuccgugagcuccuucgagcgcuucgagaucuucccgaaggacagcuccuggcccaaccacaccgucaccaagggggugacggccucgugcucccacaacggcaagagcuccuucuacaagaaccugcucuggcugaccgagaagaacgggcuguaccccaaccucagcaaguccuacgugaacaagaagggcaaggagguccuggugcuguggggcgugcaccaccccagcaacaugggcgaccagcgggccaucuaccacaaggagaacgccuacgucucggugcucuccagccacuacucccgccgguucaccccggagaucgcgaagcgccccaaggugcgggaccaggagggccgcaucaacuacuacuggacccugcuggagcccggggacacgaucaucuucgaggccaacggcaaccucaucgcccccugguacgccuucgcccugagccggggguucggcuccggcaucaucaucucgaacgcguccaugggggagugcgacgccaagugccagaccccgcagggcgccaucaacagcucccugcccuuccagaacguccaccccgugaccaucggggagugccccaaguacgugcgcagcaccaagcuccggauggucacgggccugcgcaacgugccguccauccagagccgggggcuguucggcgccaucgccggcuucaucgagggcggguggaccgggaugaucgacggcugguacggguaccaccaccagaacgagcagggcuccggcuacgcggccgaccagaaguccacccagaacgccaucaacgggaucaccaacaaggugaacucgaucaucgagaagaugaacacgcaguucaccgccgucggcaaggaguucaacaagcucgagcgccggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagacgcagcucaagaacaacgcgaaggagaucggcaacgggugcuucgaguucuaccacaagugcaacaacgagugcauggaguccgucaagaacggcaccuacgacuaccccaaguacagcaaggaguccaagcugaaccgggagaagaucgacggcgugaagcuggagagcauggggguguaccagauccucgccaucuacucgaccgucgccuccagccuggugcugcucgugucccugggcgccaucagcuucuggaugugcuccaacgggagccugcagugccgcaucugcaucuga

SEQ ID NO: 2362 - RNA, 1698 nt, Artificial Sequence
  derived and/or modified CDS sequence (AUadapt) from InfluenzaA__ABW81506__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccgggagaagaucgacggcgugaagcuggaguccaugggcaucuaccagauccuggccaucuacagcacggucgccagcucccucgugcugcuggugagccucggggccaucuccuucuggaugugcagcaacggcucccugcagugccgcaucugcaucuga

SEQ ID NO: 2363 - RNA, 1701 nt, Artificial Sequence
  derived and/or modified CDS sequence (AUadapt) from InfluenzaA__ABW81507__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccgccugaagggcaccgugccccugcagcucgggaacugcuccaucgccggcuggauccuggggaacccggagugcgagagccuguucuccaaggagagcugguccuacaucgccgagacgcccaaccccaagaacgggaccugcuaccccggcuacuucgccgacuacgaggagcuccgggagcagcugucguccgucagcuccuucgagcgcuucgagaucuucccgaaggacagcuccuggcccaaccacaccgugaccaagggggugacggcgagcugcucccacaacggcaagucguccuucuacaagaaccugcucuggcugaccgagaagaacgggcuguaccccaaccucagcaaguccuacgucaacaagaagggcaaggaggugcuggugcuguggggcguccaccaccccagcaacaugggcgaccagcgggccaucuaccacaaggagaacgccuacgugagcgugcucuccagccacuacucccgccgguucaccccggagaucgccaagcgccccaagguccgggaccaggagggccgcaucaacuacuacuggacccugcuggagcccggggacacgaucaucuucgaggcgaacggcaaccucaucgcccccugguacgccuucgcccugucgcggggguucggcuccggcaucaucaucagcaacgccuccaugggggagugcgacgcgaagugccagaccccgcagggcgccaucaacagcucccugcccuuccagaacgugcaccccgugaccaucggggagugccccaaguacguccgcagcaccaagcuccggauggugacgggccugcgcaacgugccguccauccagucgcgggggcuguucggcgccaucgccggcuucaucgagggcggguggaccgggaugaucgacggcugguacggguaccaccaccagaacgagcagggcuccggcuacgccgcggaccagaaguccacccagaacgccaucaacgggaucaccaacaaggucaacagcaucaucgagaagaugaacacgcaguucaccgccgugggcaaggaguucaacaagcucgagcgccggauggagaaccugaacaagaagguggacgacggguuccuggacaucuggaccuacaacgccgagcuccugguccugcucgagaacgagcgcacccuggacuuccacgacagcaacgugaagaaccuguacgagaaggucaagacgcagcucaagaacaacgccaaggagaucggcaacgggugcuucgaguucuaccacaagugcaacaacgagugcauggaguccgugaagaacggcaccuacgacuaccccaaguacagcaaggaguccaagcugaaccgggagaagaucgacggcgugaagcuggagucgaugggggucuaccagauccucgcgaucuacagcaccguggccuccagccuggugcugcucgucucccugggcgccaucagcuucuggaugugcuccaacgggagccugcagugccgcaucugcaucuga

SEQ ID NO: 2364 - RNA, 1698 nt, Artificial Sequence
  derived and/or modified CDS sequence (AUadapt) from InfluenzaA__ABW81508__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucacccggaagaacgggcuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacucgcggcgcuucacccccgagaucgccaagcggcccaaggugcgcgaccaggagggccggaucaacuacuacuggacccuccuggagcccggcgacaccaucaucuucgaggcgaacgggaaccugaucgccccgcgcuacgccuucgcccucucccggggcuucgggagcggcaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagucgcgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcucaaccgggagaagaucgacggggugaagcuggaguccaugggcgucuaccagauccuggccaucuacagcacgguggccagcucccucgugcugcuggucagccucggcgccaucuccuucuggaugugcagcaacgggucccugcagugccgcaucugcaucuga

SEQ ID NO: 2365 - RNA, 1701 nt, Artificial Sequence; identical to SEQ ID NO: 2361
  derived and/or modified CDS sequence (AUadapt) from InfluenzaA__ABW81509__HA

SEQ ID NO: 2366 - RNA, 1698 nt, Artificial Sequence
  derived and/or modified CDS sequence (AUadapt) from InfluenzaA__ABW81511__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccucguggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacuccaucaucuucgaggcgaacgggaaccugaucgccccgugguacgccuucgcccucucgcggggcuucggcuccgggaucaucaccagcaacgcccccauggacgagugcgacgcgaagugccagacgccccagggcgccaucaacuccagccugcccuuccagaacguccacccggugaccaucggggagugccccaaguacgugcgcuccgccaagcugcggauggucaccggccuccgcaacauccccagcauccagucccgggggcuguucggcgccaucgccggcuucaucgagggcggguggaccgggaugguggacggcugguacggguaccaccaccagaacgagcagggcagcggcuacgcggccgaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggguuccuggacaucuggacguacaacgccgagcugcucgugcugcuggagaacgagcgcacccucgacuuccacgacuccaacgugaagaaccuguacgagaaggucaagucgcagcugaagaacaacgcgaaggagaucggcaacgggugcuucgaguucuaccacaagugcaacaacgagugcauggaguccgugaagaacggcaccuacgacuaccccaaguacagcgaggaguccaagcucaaccgggagaagaucgacggcgugaagcuggagagcaugggggucuaccagauccuggccaucuacagcaccguggccuccagccucgugcugcuggucucccucggcgccaucagcuucuggaugugcuccaacgggagccugcagugccgcaucugcaucuga

SEQ ID NO: 2367 - RNA, 1698 nt, Artificial Sequence; identical to SEQ ID NO: 541
  derived and/or modified CDS sequence (AUadapt) from InfluenzaA__ABW81512__HA

SEQ ID NO: 2368 - RNA, 1698 nt, Artificial Sequence; identical to SEQ ID NO: 1630
  derived and/or modified CDS sequence (AUadapt) from InfluenzaA__ABW81513__HA

SEQ ID NO: 2369 - RNA, 1698 nt, Artificial Sequence
  derived and/or modified CDS sequence (AUadapt) from InfluenzaA__ABW81514__HA
augaaggugaagcugcucguccugcugugcaccuucaccgccacguacgccgacaccaucugcaucucguaccacgcgaacaacuccaccgacaccguggacacggugcucgagaagaacgucaccgugacccacagcgugaaccugcuggaggacucccacaacggcaagcucugccugcugaaggggaucgcgccccuccagcugggcaacugcagcgucgccggguggauccugggcaacccggagugcgagcuccugaucuccaaggagagcugguccuacaucguggagacccccaaccccgagaacgggacgugcuaccccggcuacuucgccgacuacgaggagcugcgcgagcagcucagcuccgugucguccuucgagcgguucgagaucuucccgaaggagagcuccuggcccaaccacaccgucaccggcgugagcgccuccugcagccacaacgggaaguccagcuucuaccgcaaccugcuguggcucaccggcaagaacgggcuguaccccaaccuguccaagucguacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggcgacaccaucaucuucgaggcgaacgggaaccugaucgccccgcgguucgccuucgcccucagccgcggcuucggguccggcaucaucacgagcaacgcccccauggacgagugcgacgcgaagugccagacgccccagggcgccaucaacuccucgcugcccuuccagaacguccacccggugaccaucggggagugccccaaguacgugcgguccgccaagcugcgcauggccaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacccagaacgccaucaacggcaucaccaacaaggugaacagcgugaucgagaagaugaacacccaguucacggccgucggcaaggaguucuccaagcuggagcggcgcauggagaaccucaacaagaagguggacgacggguuccuggacaucuggaccuacaacgcggagcugcucguccugcuggagaacgagcggacccucgacuuccacgacagcaacgugaagaaccuguacgagaaggugaagucccagcugaagaacaacgccaaggagaucggcaacgggugcuucgaguucuaccacaagugcaacgacgagugcauggagucggucaagaacggcaccuacgacuaccccaaguacuccgaggagagcaagcucaaccgcgagaagaucgacggggugaagcuggagagcaugggcguguaccagauccuggccaucuacuccacggucgccagcucccucgugcugcuggugagccucggcgccaucuccuucuggaugugcagcaacgggucccugcagugccggaucugcaucuga

SEQ ID NO: 2370 - RNA, 1698 nt, Artificial Sequence; identical to SEQ ID NO: 1630
  derived and/or modified CDS sequence (AUadapt) from InfluenzaA__ABW81515__HA

SEQ ID NO: 2371 - RNA, 1698 nt, Artificial Sequence; identical to SEQ ID NO: 1630
  derived and/or modified CDS sequence (AUadapt) from InfluenzaA__ABW81516__HA

SEQ ID NO: 2372 - RNA, 1698 nt, Artificial Sequence
  derived and/or modified CDS sequence (AUadapt) from InfluenzaA__ABW81517__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgaucuccagcuucgagcgguucgagaucuucccgaaggaguccagcuggcccaaccacaccgugaccggggucuccgccagcugcucccacaacggcaagucguccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggccaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacucggugaucgagaagaugaacacccaguucacggccguggggaaggaguucagcaagcuggagcggcgcauggagaaccucaacaagaaggucgacgacggcuuccuggacaucuggaccuacaacgcggagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacgguggccuccagccucguccugcuggugucccucggggccaucagcuucuggaugugcuccaacggcagccugcagugccggaucugcaucuga

SEQ ID NO: 2373 - RNA, 1698 nt, Artificial Sequence
  derived and/or modified CDS sequence (AUadapt) from InfluenzaA__ABW81518__HA
augaaggugaagcugcucguccugcugugcaccuacaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccucgugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugucgucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacucgucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucucgaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacucgacggucgccuccagccucgugcugcuggugucccucggggccaucagcuucuggaugugcuccaacggcagccugcagugccggaucugcaucuga

SEQ ID NO: 2374 - RNA, 1698 nt, Artificial Sequence
  derived and/or modified CDS sequence (AUadapt) from InfluenzaA__ABW81519__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccucgugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgcccacgugagcgucgugucgucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacucgucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucucgaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacucgacggucgccuccagccucgugcugcuggugucccucggggccaucagcuucuggaugugcuccaacggcagccugcagugccggaucugcaucuga

SEQ ID NO: 2375 - RNA, 1698 nt, Artificial Sequence
  derived and/or modified CDS sequence (AUadapt) from InfluenzaA__ABW81520__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcugggguccugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgcgagcagcucagcuccgugucguccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagucguacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccucgcugcccuuccagaacguccacccggugaccaucggcgagugccccaaguacgugcgguccgccaagcugcgcauggccaccgggcuccggaacauccccagcauccagucccgcggccuguucggggccaucgcgggcuucaucgagggcggguggaccggcauggucgacgggugguacggcuaccaccaccagaacgagcaggggagcggcuacgccgccgaccagaaguccacccagaacgccaucaacggcaucaccaacaaggugaacagcgugaucgagaagaugaacacccaguucacggccgucgggaaggaguucuccaagcuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagucggucaagaacgggaccuacgacuaccccaaguacuccgaggagagcaagcucaaccgcgagaagaucgacggcgugaagcuggagagcaugggcguguaccagauccuggccaucuacuccacggucgccagcucccucgugcugcuggugagccucggggccaucuccuucuggaugugcagcaacggcucccugcagugccggaucugcaucuga

SEQ ID NO: 2376 - RNA, 1698 nt, Artificial Sequence
  derived and/or modified CDS sequence (AUadapt) from InfluenzaA__ABW81521__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucuccagcaacgcccccauggacgagugcgacgcgaagugccagacgccccagggggccaucaacuccucgcugcccuuccagaacguccacccggugaccaucggcgagugccccaaguacgugcgguccgccaagcugcgcauggccaccgggcuccggaacauccccagcauccagucccgcggccuguucggggccaucgcgggcuucaucgagggcggguggaccggcauggucgacgggugguacggcuaccaccaccagaacgagcaggggagcggcuacgccgccgaccagaaguccacgcagaacgccaucaacggcaucaccaacaaggugaacagcgugaucgagaagaugaacacccaguucaccgccgucgggaaggaguucuccaagcuggagcggcgcauggagaaccucaacaagaagguggacgacggcuuccuggacaucuggacguacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagucggucaagaacgggaccuacgacuaccccaaguacuccgaggagagcaagcucaaccgcgagaagaucgacggcgugaagcuggagagcaugggcguguaccagauccuggccaucuacuccaccgucgccagcucccucgugcugcuggugagccucggggccaucuccuucuggaugugcagcaacggcucccugcagugccggaucugcaucuga

SEQ ID NO: 2377 - RNA, 1698 nt, Artificial Sequence; identical to SEQ ID NO: 1630
  derived and/or modified CDS sequence (AUadapt) from InfluenzaA__ABW81522__HA

SEQ ID NO: 2378 - RNA, 1698 nt, Artificial Sequence; identical to SEQ ID NO: 1630
  derived and/or modified CDS sequence (AUadapt) from InfluenzaA__ABW81523__HA

SEQ ID NO: 2379 - RNA, 1698 nt, Artificial Sequence
  derived and/or modified CDS sequence (AUadapt) from InfluenzaA__ABW81524__HA
augaaggugaagcugcucguccugcugugcaccuucaccgccacguacgccgacaccaucugcaucggcuaccacgcgaacaacucgaccgacaccaucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgugaccggggucuccgccagcugcucccacaacggcaagucguccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggccaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacucggugaucgagaagaugaacacccaguucacggccguggggaaggaguucagcaagcuggagcggcgcauggagaaccucaacaagaaggucgacgacggcuuccuggacaucuggaccuacaacgcggagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacgguggccuccagccucguccugcuggugucccucggggccaucagcuucuggaugugcuccaacggcagccugcagugccggaucugcaucuga

SEQ ID NO: 2380 - RNA, 1698 nt, Artificial Sequence
  derived and/or modified CDS sequence (AUadapt) from InfluenzaA__ABW81526__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcaagagcuccuucuacaagaaccugcuguggcucaccgggaagaacggccuguaccccaaccugucgaaguccuacgccaacaacaaggagaaggaggugcucguccuguggggcgugcaccacccgcccaacaucggcgaccagaaggcccuguaccacaccgagaacgccuacgugagcgucgugagcucccacuacucgcgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggggaagugcgacgcgaagugccagacgccccagggcgccaucaacagcucccugcccuuccagaacguccacccggugaccaucggggagugccccaaguacgugcgcucggccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggaccuccacgacucgaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgggagaagaucgacggcgugaagcuggaguccaugggggucuaccagauccuggccaucuacucgaccguggccagcucccucgugcugcuggucagccucggcgccaucuccuucuggaugugcagcaacgggucccugcagugccgcaucugcaucuga

SEQ ID NO: 2381 - RNA, 1698 nt, Artificial Sequence
  derived and/or modified CDS sequence (AUadapt) from InfluenzaA__ABW81527__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcggaaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacggucgccuccagccucgugcugcuggugucccucggggccaucagcuucuggaugugcuccaacggcagccugcagugccggaucugcaucuga

SEQ ID NO: 2382 - RNA, 1698 nt, Artificial Sequence
  derived and/or modified CDS sequence (AUadapt) from InfluenzaA__ABW81528__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggccacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccugugggggauccaccacccgcccaacaucggcgaccagcgggcccuguaccacacggagaacgccuacgugagcguggucagcucccacuacucgcgccgguucacccccgagaucgccaagcgccccaaggugcgggaccaggagggccgcaucaacuacuacuggacccuccuggagccccgggacaccaucaucuucgaggcgaacgggaaccugaucgccccgcgcuucgccuucgcccucucccggggcuucgggagcggcaucaucacguccaacgcccccauggacgagugcgacgcgaagugccagacgccccagggcgccaucaacagcucccugcccuuccagaacgugcacccggucaccaucggggagugccccaaguacgugcgcagcgccaagcugcggauggugaccggccuccgcaacauccccuccauccagucgcgggggcuguucggcgccaucgccggguucaucgagggcggcuggaccgggauggucgacggcugguacggguaccaccaccagaacgagcagggcuccggguacgcggccgaccagaaguccacccagaacgccaucaacggcaucaccaacaaggugaacagcgugaucgagaagaugaacacccaguucacggccgucggcaaggaguucaacaagcuggagcgccggauggagaaccucaacaagaagguggacgacggguuccuggacaucuggaccuacaacgccgagcugcucguccugcuggagaacgagcgcacccucgacuuccacgacagcaacgugaagaaccuguacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagucgaagcucaaccgggagaagaucgacggggugaagcuggaguccaugggcguguaccagauccuggccaucuacagcacggucgccagcucccucgugcugcuggugagccucggcgccaucuccuucuggaugugcagcaacgggucccugcagugccgcaucugcaucuga

SEQ ID NO: 2383 - RNA, 1698 nt, Artificial Sequence
  derived and/or modified CDS sequence (AUadapt) from InfluenzaA__ABW81529__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagccgcgaguccuggagcuacaucgucgagacccccaaccccgagaacggcacgugcuaccccggcuacuucgccgacuacgaggagcugcgggagcagcucuccagcguguccagcuucgagcgcuucgagaucuucccgaaggaguccucguggcccaaccacaccgugaccggggucuccgccagcugcucccacaacggcaagagcuccuucuaccggaaccugcuguggcucaccgggaagaacggccuguaccccaaccugagcaaguccuacgccaacaacaaggagaaggaggugcucauccuguggggcgugcaccacccgcccaacauccgcgaccagaugacgcuguaccacaccgagaacgccuacgucagcguggugagcucccacuacucgcggcgcuucacccccgagaucaccaagcggcccaagguccgcgaccaggaggggcggaucaacuacuacuggacgcuccuggagcccggcgacaccaucaucuucgaggccaacgggaaccugaucgccccgugguacgcguucgcccucucccgcggcuucgggagcggcaucaucaccuccaacgcccccauggacgagugcgacgccaagugccagacccccaagggcgccaucaacagcucccugcccuuccagaacgugcacccggugacgaucggggagugccccaaguacguccggagcgcgaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgccgaccagaaguccacccagaacgcgaucaacggcaucacgaacaaggucaacagcgugaucgagaagaugaacacccaguucaccgccgugggcaaggaguucaacaagcuggagcggcgcauggagaaccucaacaagaaggucgacgacggguuccuggacaucuggaccuacaacgccgagcugcucgugcugcuggagaacgagcggacgcucgacuuccacgacucgaacgucaagaaccuguacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagagcaagcucaaccgcgagaagaucgacggggucaagcuggaguccaugggcguguaccagauccuggccaucuacagcaccguggcgagcucccucguccugcuggugagccucggcgccaucuccuucuggaugugcagcaacgggucccugcagugccggaucugcaucuga

SEQ ID NO: 2384 - RNA, 1698 nt, Artificial Sequence
  derived and/or modified CDS sequence (AUadapt) from InfluenzaA__ABW81530__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccucguucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucucgguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcucggccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaaccgcaucaccaacaaggucaacagcgugaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcacguacgacuaccccaaguacuccgaggagucgaagcucaaccgcgagaagaucgacggggucaagcuggacuccaugggcguguaccagauccuggcgaucuacagcaccguggccagcucccucguccugcuggugagccucggcgccaucuccuucuggaugugcagcaacgggucccugcagugccggaucugcaucuga

SEQ ID NO: 2385 - RNA, 1698 nt, Artificial Sequence; identical to SEQ ID NO: 571
  derived and/or modified CDS sequence (AUadapt) from InfluenzaA__ABW81531__HA

SEQ ID NO: 2386 - RNA, 1698 nt, Artificial Sequence
  derived and/or modified CDS sequence (AUadapt) from InfluenzaA__ABW81532__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccugguacuucgccgacuacgaggagcugcgcgagcagcucuccagcguguccagcuucgagcgguucgagaucuucccgaaggaguccucguggcccaaccacacggugaccggcgucuccgccagcugcucccacaacggcaagagcuccuucuaccgcaaccugcuguggcucaccgggaagaacgggcuguaccccaaccugagcaaguccuacgccaacaacaaggagaaggaggugcucauccuguggggcgugcaccacccgcccaacaucgggaaccagcggacccuguaccacacggagaacgccuacgucagcguggugagcucccacuacucgcgccgguucacccccgagaucaccaagcgccccaagguccgggaccaggagggccgcaucaacuacuacuggacccuccuggagcccggcgacacgaucaucuucgaggccaacgggaaccugaucgcgccgugguacgccuucgcccucucccggggcuucgggagcggcaucaucaccuccaacgcccccauggacgagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacccagaacgccaucaacggcaucaccaacaaggucaacagcgugaucgagaagaugaacacgcaguucaccgccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacucgaacgucaagaaccuguacgagaaggugaagucccagcugaagaacaacgccaaggagaucggcaacgggugcuucgaguucuaccacaagugcaacaacgagugcauggagagcgugaagaacggcacguacgacuaccccaaguacuccgaggagagcaagcucaaccgggagaagaucgacggggucaagcuggacuccaugggcguguaccagauccuggcgaucuacagcaccguggccagcucccucguccugcuggugagccucggcgccaucuccuucuggaugugcagcaacgggucccugcagugccgcaucugcaucuga

SEQ ID NO: 2387 - RNA, 1698 nt, Artificial Sequence; identical to SEQ ID NO: 2201
  derived and/or modified CDS sequence (AUadapt) from InfluenzaA__ABW86321__HA

SEQ ID NO: 2388 - RNA, 1698 nt, Artificial Sequence; identical to SEQ ID NO: 2166
  derived and/or modified CDS sequence (AUadapt) from InfluenzaA__ABW86332__HA

SEQ ID NO: 2389 - RNA, 1698 nt, Artificial Sequence; identical to SEQ ID NO: 2155
  derived and/or modified CDS sequence (AUadapt) from InfluenzaA__ABW86343__HA

SEQ ID NO: 2390 - RNA, 1698 nt, Artificial Sequence; identical to SEQ ID NO: 2159
  derived and/or modified CDS sequence (AUadapt) from InfluenzaA__ABW86354__HA

SEQ ID NO: 2391 - RNA, 1698 nt, Artificial Sequence; identical to SEQ ID NO: 2159
  derived and/or modified CDS sequence (AUadapt) from InfluenzaA__ABW86365__HA

SEQ ID NO: 2392 - RNA, 1698 nt, Artificial Sequence; identical to SEQ ID NO: 2175
  derived and/or modified CDS sequence (AUadapt) from InfluenzaA__ABW86376__HA

SEQ ID NO: 2393 - RNA, 1698 nt, Artificial Sequence; identical to SEQ ID NO: 2159
  derived and/or modified CDS sequence (AUadapt) from InfluenzaA__ABW86387__HA

SEQ ID NO: 2394 - RNA, 1698 nt, Artificial Sequence; identical to SEQ ID NO: 2155
  derived and/or modified CDS sequence (AUadapt) from InfluenzaA__ABW86409__HA

SEQ ID NO: 2395 - RNA, 1698 nt, Artificial Sequence; identical to SEQ ID NO: 2155
  derived and/or modified CDS sequence (AUadapt) from InfluenzaA__ABW86431__HA

SEQ ID NO: 2396 - RNA, 1698 nt, Artificial Sequence; identical to SEQ ID NO: 2159
  derived and/or modified CDS sequence (AUadapt) from InfluenzaA__ABW86442__HA

SEQ ID NO: 2397 - RNA, 1698 nt, Artificial Sequence; identical to SEQ ID NO: 2175
  derived and/or modified CDS sequence (AUadapt) from InfluenzaA__ABW86453__HA

SEQ ID NO: 2398 - RNA, 1698 nt, Artificial Sequence; identical to SEQ ID NO: 2159
  derived and/or modified CDS sequence (AUadapt) from InfluenzaA__ABW86464__HA

SEQ ID NO: 2399 - RNA, 1698 nt, Artificial Sequence; identical to SEQ ID NO: 2175
  derived and/or modified CDS sequence (AUadapt) from InfluenzaA__ABW86475__HA

SEQ ID NO: 2400 - RNA, 1698 nt, Artificial Sequence; identical to SEQ ID NO: 2155
  derived and/or modified CDS sequence (AUadapt) from InfluenzaA__ABW86486__HA

SEQ ID NO: 2401 - RNA, 1698 nt, Artificial Sequence; identical to SEQ ID NO: 2201
  derived and/or modified CDS sequence (AUadapt) from InfluenzaA__ABW86497__HA

SEQ ID NO: 2402 - RNA, 1698 nt, Artificial Sequence; identical to SEQ ID NO: 2159
  derived and/or modified CDS sequence (AUadapt) from InfluenzaA__ABW86508__HA

SEQ ID NO: 2403 - RNA, 1698 nt, Artificial Sequence
  derived and/or modified CDS sequence (AUadapt) from InfluenzaA__ABW86519__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcggaaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 2404 - RNA, 1698 nt, Artificial Sequence; identical to SEQ ID NO: 2155
  derived and/or modified CDS sequence (AUadapt) from InfluenzaA__ABW86530__HA

SEQ ID NO: 2405 - RNA, 1698 nt, Artificial Sequence
  derived and/or modified CDS sequence (AUadapt) from InfluenzaA__ABW86541__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccucguggcugaaccacaccgucaccgggguguccgccagcugcucccacaacggcaagagcuccuucuaccgcaaccugcucuggcugaccgggaagaacggccuguaccccaaccucagcaaguccuacgccaacaacaaggagaaggaggugcugguccuguggggcgugcaccacccgcccaacaucggggaccagcgggcccucuaccacacggagaacgccuacgugagcgucgugagcucccacuacucgcgccgguucacccccgagaucgccaagcgccccaaggugcgggaccaggagggccgcaucaacuacuacuggacccugcuggagcccggggacaccaucaucuucgaggcgaacggcaaccucaucgcgccccgguucgccuucgcccugucccgcggguucggcagcggcaucaucacguccaacgccccgaugggggagugcgacgccaagugccagacgccccagggcgccaucaacagcucccugcccuuccagaacguccaccccgugaccaucggggagugcccgaaguacgugcggagcgccaagcuccgcauggucaccggccugcggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcucgagcggcgcauggagaaccugaacaagaaggucgacgacggguuccuggacaucuggaccuacaacgccgagcuccuggugcugcucgagaacgagcggacccuggacuuccacgacucgaacgugaagaaccuguacgagaaggucaagucccagcucaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcuggaguccaugggggucuaccagauccucgccaucuacagcacgguggccagcucccuggugcugcucgucagccugggcgccaucuccuucuggaugugcagcaacgggucccugcagugccggaucugcaucuga

SEQ ID NO: 2406 - RNA, 1698 nt, Artificial Sequence; identical to SEQ ID NO: 2155
  derived and/or modified CDS sequence (AUadapt) from InfluenzaA__ABW86552__HA

SEQ ID NO: 2407 - RNA, 1701 nt, Artificial Sequence
  derived and/or modified CDS sequence (AUadapt) from InfluenzaA__ABW86563__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggccacaaggacuggauccuguggaucuccuucgccaucagcugcuuccuccugugcguggcccugcucggcuucaucaugugggccugccagaaggggaacauccgcugcaacaucugcaucuga

SEQ ID NO: 2408 - RNA, 1698 nt, Artificial Sequence; identical to SEQ ID NO: 2192
  derived and/or modified CDS sequence (AUadapt) from InfluenzaA__ABW86606__HA

SEQ ID NO: 2409 - RNA, 1701 nt, Artificial Sequence; identical to SEQ ID NO: 1166
  derived and/or modified CDS sequence (AUadapt) from InfluenzaA__ABW91185__HA

SEQ ID NO: 2410 - RNA, 1701 nt, Artificial Sequence
  derived and/or modified CDS sequence (AUadapt) from InfluenzaA__ABW91196__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2411 - RNA, 1701 nt, Artificial Sequence; identical to SEQ ID NO: 2410
  derived and/or modified CDS sequence (AUadapt) from InfluenzaA__ABW91207__HA

SEQ ID NO: 2412 - RNA, 1698 nt, Artificial Sequence; identical to SEQ ID NO: 2155
  derived and/or modified CDS sequence (AUadapt) from InfluenzaA__ABW91218__HA

SEQ ID NO: 2413 - RNA, 1701 nt, Artificial Sequence; identical to SEQ ID NO: 2173
  derived and/or modified CDS sequence (AUadapt) from InfluenzaA__ABW91240__HA

SEQ ID NO: 2414 - RNA, 1701 nt, Artificial Sequence
  derived and/or modified CDS sequence (AUadapt) from InfluenzaA__ABW91251__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaaguccggcgacauccugcucaucaacucgaccgggaaccugaucgcgccccggggcuacuucaagauccgcuccgggaaguccuccaucaugcggagcgacgccccgaucggcaagugcaacuccgagugcaucacgcccaacggcucgauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 2415 - RNA, 1701 nt, Artificial Sequence; identical to SEQ ID NO: 2173
  derived and/or modified CDS sequence (AUadapt) from InfluenzaA__ABW91262__HA

SEQ ID NO: 2416 - RNA, 1698 nt, Artificial Sequence; identical to SEQ ID NO: 2190
  derived and/or modified CDS sequence (AUadapt) from InfluenzaA__ABW91273__HA

SEQ ID NO: 2417 - RNA, 1698 nt, Artificial Sequence
  derived and/or modified CDS sequence (AUadapt) from InfluenzaA__ABW91284__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccucguggcccaaccacacgaccaccggggucuccgccagcugcucccacaacggcgagagcuccuucuacaagaaccugcuguggcucaccgggaagaacggccuguaccccaaccugucgaaguccuacgccaacaacaaggagaaggaggugcucgugcuguggggcguccaccacccgcccaacaucggcgaccagcgggcccuguaccacacggagaacgccuacgugagcguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcucgggcaucaucaacuccaacgccagcaugggggagugcgacgcgaagugccagacgccccagggcgccaucaacuccagccugcccuuccagaacgugcaccccgucaccaucggggagugcccgaaguacgugcgcuccgccaagcugcggauggugaccggccuccgcaacauccccucgauccagucccgggggcuguucggcgccaucgccggcuucaucgagggcggguggaccgggauggucgacggcugguacggguaccaccaccagaacgagcagggcagcggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgggagaagaucgacggcgugaagcucgagagcauggggguguaccagauccuggccaucuacucgaccgucgccuccagccuggugcuccuggugucccugggcgccaucagcuucuggaugugcuccaacgggagccuccagugccgcaucugcaucuga

SEQ ID NO: 2418 - RNA, 1698 nt, Artificial Sequence; identical to SEQ ID NO: 2190
  derived and/or modified CDS sequence (AUadapt) from InfluenzaA__ABW91295__HA

SEQ ID NO: 2419 - RNA, 1698 nt, Artificial Sequence; identical to SEQ ID NO: 2159
  derived and/or modified CDS sequence (AUadapt) from InfluenzaA__ABW91306__HA

SEQ ID NO: 2420 - RNA, 1698 nt, Artificial Sequence; identical to SEQ ID NO: 2159
  derived and/or modified CDS sequence (AUadapt) from InfluenzaA__ABW91317__HA

SEQ ID NO: 2421 - RNA, 1698 nt, Artificial Sequence
  derived and/or modified CDS sequence (AUadapt) from InfluenzaA__ABW91328__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugcgcucccagcugaagaacaacgccaaggagaucgggaacggcugcuucgaguucuaccacaagugcaacgacgagugcauggagagcgucaagaacgggacguacgacuaccccaaguacuccgaggagucgaagcucaaccgggagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccgcaucugcaucuga

SEQ ID NO: 2422 - RNA, 1698 nt, Artificial Sequence; identical to SEQ ID NO: 2159
  derived and/or modified CDS sequence (AUadapt) from InfluenzaA__ABW91339__HA

SEQ ID NO: 2423 - RNA, 1698 nt, Artificial Sequence; identical to SEQ ID NO: 2159
  derived and/or modified CDS sequence (AUadapt) from InfluenzaA__ABW91350__HA

SEQ ID NO: 2424 - RNA, 1698 nt, Artificial Sequence
  derived and/or modified CDS sequence (AUadapt) from InfluenzaA__ABW91361__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacaagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagacccgcggccuguucggggccaucgccggcuucaucgagggcggguggaccggcaugguggacgggugguacggcuaccaccaccagaacgagcaggggucgggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuuccuggacaucuggaccuacaacgccgagcugcucgugcugcuggagaacgagcggacgcucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcgucuaccagauccuggcgaucuacuccaccguggccagcagccucgugcugcuggucucccucggggccaucagcuucuggaugugcuccaacggcagccugcagugccggaucugcaucuga

SEQ ID NO: 2425 - RNA, 1698 nt, Artificial Sequence; identical to SEQ ID NO: 2159
  derived and/or modified CDS sequence (AUadapt) from InfluenzaA__ABW91372__HA

SEQ ID NO: 2426 - RNA, 1698 nt, Artificial Sequence; identical to SEQ ID NO: 2192
  derived and/or modified CDS sequence (AUadapt) from InfluenzaA__ABW91383__HA

SEQ ID NO: 2427 - RNA, 1701 nt, Artificial Sequence; identical to SEQ ID NO: 2232
  derived and/or modified CDS sequence (AUadapt) from InfluenzaA__ABW91394__HA

SEQ ID NO: 2428 - RNA, 1698 nt, Artificial Sequence; identical to SEQ ID NO: 2201
  derived and/or modified CDS sequence (AUadapt) from InfluenzaA__ABW91405__HA

SEQ ID NO: 2429 - RNA, 1698 nt, Artificial Sequence
  derived and/or modified CDS sequence (AUadapt) from InfluenzaA__ABW91416__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugucggucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccaugggggagugcgacgcgaagugccagacgccccagggcgccaucaacagcucccugcccuuccagaacguccacccggugaccaucggggagugccccaaguacgugcgcucggccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 2430 - RNA, 1698 nt, Artificial Sequence; identical to SEQ ID NO: 2304
  derived and/or modified CDS sequence (AUadapt) from InfluenzaA__ABW91427__HA

SEQ ID NO: 2431 - RNA, 1701 nt, Artificial Sequence; identical to SEQ ID NO: 2173
  derived and/or modified CDS sequence (AUadapt) from InfluenzaA__ABW91438__HA

SEQ ID NO: 2432 - RNA, 1698 nt, Artificial Sequence; identical to SEQ ID NO: 2201
  derived and/or modified CDS sequence (AUadapt) from InfluenzaA__ABW91449__HA

SEQ ID NO: 2433 - RNA, 1698 nt, Artificial Sequence; identical to SEQ ID NO: 2201
  derived and/or modified CDS sequence (AUadapt) from InfluenzaA__ABW91460__HA

SEQ ID NO: 2434 - RNA, 1698 nt, Artificial Sequence
  derived and/or modified CDS sequence (AUadapt) from InfluenzaA__ABW91471__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcgucgcgccccuccagcuggggaacugcuccguggccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcgucuccucguucgagcgguucgagaucuucccgaaggaguccagcuggcccaaccacaccgugaccgggguguccgccagcugcucccacaacggcaagagcuccuucuaccgcaaccugcuguggcucaccgggaagaacggccuguaccccaaccugagcaaguccuacgccaacaacaaggagaaggagguccucgugcuguggggcgugcaccacccgcccaacaucggggaccagcgggcccuguaccacacggagaacgccuacgucucgguggugagcucccacuacagccgccgguucacccccgagaucgccaagcgccccaagguccgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggugaccaucggcgagugccccaaguacguccggucgaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgucaagcuggaguccaugggcguguaccagauccuggcgaucuacagcaccguggccagcucccucguccugcuggugagccucggggccaucuccuucuggaugugcagcaacggcucccugcagugccggaucugcaucuga

SEQ ID NO: 2435 - RNA, 1698 nt, Artificial Sequence
  derived and/or modified CDS sequence (AUadapt) from InfluenzaA__ABW91482__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugucguccuucgagcgcuucgagaucuucccgaaggagagcuccuggcccaaccacaccgucaccggggugagcgccuccugcagccacaacggccgguccucguucuaccgcaaccugcuguggcucaccgggaagaacggccuguaccccaaccugucccggagcuacgccaacaacaaggagaaggaggugcucguccuguggggcgugcaccacccgcccaacaucggggaccagcgcgcccuguaccacacggagaacgccuacguguccgucgugagcagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucgcggggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagucgaugggcgucuaccagauccuggccaucuacuccacgguggccagcagccucgugcugcuggucucccucggggccaucagcuucuggaugugcuccaacggcagccugcagugccgcaucugcaucuga

SEQ ID NO: 2436 - RNA, 1698 nt, Artificial Sequence
  derived and/or modified CDS sequence (AUadapt) from InfluenzaA__ABW91493__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagaagcggauggagaaccucaacaagaagguggacgacggcuuccuggacaucuggaccuacaacgccgagcugcucguccugcuggagaacgagcgcacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagucgaagcucaaccgggagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccgcaucugcaucuga

SEQ ID NO: 2437 - RNA, 1698 nt, Artificial Sequence; identical to SEQ ID NO: 2175
  derived and/or modified CDS sequence (AUadapt) from InfluenzaA__ABW91504__HA

SEQ ID NO: 2438 - RNA, 1698 nt, Artificial Sequence
  derived and/or modified CDS sequence (AUadapt) from InfluenzaA__ABW91515__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacgugguggagacccccaaccccgagaacggcacgugcuaccccggcuacuucgccgacuacgaggagcugcgggagcagcucagcuccgucucguccuucgagcgcuucgagaucuucccgaaggagagcuccuggcccaaccacaccgugaccggggugagcgccuccugcagccacaacggcaaguccucguucuaccggaaccugcuguggcucaccgggaagaacggccuguaccccaaccuguccaagagcuacgccaacaacaaggagaaggagguccucgugcuguggggcgugcaccacccgcccaacaucggggaccagcgcgcccuguaccacacggagaacgccuacgucuccguggugagcagccacuacucccggcgcuucacccccgagaucgccaagcggcccaagguccgcgaccaggagggccggaucaacuacuacuggacccuccuggagcccggggacaccaucaucuucgaggcgaacggcaaccugaucgccccgcgcuucgccuucgcccucucgcggggguucggcuccggcaucaucacgagcaacgcccccauggacgagugcgacgcgaagugccagacgccccagggggccaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggucaacagcgugaucgagaagaugaacacccaguucacggccgucgggaaggaguucaacaagcuggagcgccggauggagaaccucaacaagaagguggacgacggcuuccuggacaucuggaccuacaacgccgagcugcucgugcugcuggagaacgagcgcacccucgacuuccacgacuccaacgucaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagucgaugggcguguaccagauccuggccaucuacuccacgguggccagcagccucguccugcuggugucccucggggccaucagcuucuggaugugcuccaacggcagccugcagugccgcaucugcaucuga

SEQ ID NO: 2439 - RNA, 1698 nt, Artificial Sequence
  derived and/or modified CDS sequence (AUadapt) from InfluenzaA__ABW91526__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggagcaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucgacccgccugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 2440 - RNA, 1698 nt, Artificial Sequence; identical to SEQ ID NO: 2159
  derived and/or modified CDS sequence (AUadapt) from InfluenzaA__ABW91537__HA

SEQ ID NO: 2441 - RNA, 1701 nt, Artificial Sequence; identical to SEQ ID NO: 2232
  derived and/or modified CDS sequence (AUadapt) from InfluenzaA__ABW91548__HA

SEQ ID NO: 2442 - RNA, 1698 nt, Artificial Sequence
  derived and/or modified CDS sequence (AUadapt) from InfluenzaA__ABW91559__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccucguggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacucgaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcucuaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 2443 - RNA, 1698 nt, Artificial Sequence; identical to SEQ ID NO: 2300
  derived and/or modified CDS sequence (AUadapt) from InfluenzaA__ABW91570__HA

SEQ ID NO: 2444 - RNA, 1698 nt, Artificial Sequence; identical to SEQ ID NO: 2175
  derived and/or modified CDS sequence (AUadapt) from InfluenzaA__ABW91581__HA

SEQ ID NO: 2445 - RNA, 1698 nt, Artificial Sequence; identical to SEQ ID NO: 2155
  derived and/or modified CDS sequence (AUadapt) from InfluenzaA__ABW91592__HA

SEQ ID NO: 2446 - RNA, 1698 nt, Artificial Sequence; identical to SEQ ID NO: 2201
  derived and/or modified CDS sequence (AUadapt) from InfluenzaA__ABW91603__HA

SEQ ID NO: 2447 - RNA, 1698 nt, Artificial Sequence
  derived and/or modified CDS sequence (AUadapt) from InfluenzaA__ABW91614__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccucccccgagaacggcacgugcuaccccggcuacuucgccgacuacgaggagcugcgcgagcagcucagcuccgugagcuccuucgagcgguucgagaucuucccgaaggagucguccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucagcuccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguuccuggacaucuggacguacaacgccgagcugcucgugcugcuggagaacgagcggacccucgacuuccacgacucgaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgcgagaagaucgacggcgugaagcuggagagcaugggggucuaccagauccuggccaucuacuccaccguggccagcucccucgugcugcuggucagccucggcgccaucuccuucuggaugugcagcaacgggucccugcagugccggaucugcaucuga

SEQ ID NO: 2448 - RNA, 1698 nt, Artificial Sequence; identical to SEQ ID NO: 2190
  derived and/or modified CDS sequence (AUadapt) from InfluenzaA__ABW91625__HA

SEQ ID NO: 2449 - RNA, 1698 nt, Artificial Sequence; identical to SEQ ID NO: 2159
  derived and/or modified CDS sequence (AUadapt) from InfluenzaA__ABW91636__HA

SEQ ID NO: 2450 - RNA, 1701 nt, Artificial Sequence; identical to SEQ ID NO: 2232
  derived and/or modified CDS sequence (AUadapt) from InfluenzaA__ABW91647__HA

SEQ ID NO: 2451 - RNA, 1707 nt, Artificial Sequence
  derived and/or modified CDS sequence (AUadapt) from InfluenzaA__ABX10515__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagucguccuggagcucccacgaggugagccugggcguguccucggccugcccguaccagggcaaguccagcuucuuccgcaacgucguguggcugaucaagaagaacuccaccuaccccacgaucaagcggagcuacaacaacaccaaccaggaggaccuccuggugcugugggggauccaccaccccaacgacgccgcggagcagaccaagcucuaccagaacccgaccacguacaucuccgucggcaccucgacccugaaccagcgccuggugccccggaucgccacccgcuccaaggugaacgggcagagcggccggauggaguucuucuggacgauccucaagcccaacgacgccaucaacuucgagagcaacgggaacuucaucgcccccgaguacgcguacaagaucgucaagaagggcgacuccaccaucaugaaguccgagcuggaguacggcaacugcaacaccaagugccagaccccgaugggggccaucaacagcucgaugcccuuccacaacauccacccccugacgaucggcgagugccccaaguacgugaaguccaaccgccucgugcuggccaccgggcugcggaacagcccgcagcgcgagcggcgccggaagaagcgcggccucuucggcgccaucgccggguucaucgagggcggguggcagggcauggucgacgggugguacggcuaccaccacuccaacgagcagggcagcggguacgcggccgacaaggaguccacccagaaggccaucgacggcgugaccaacaaggugaacucgaucaucgacaagaugaacacgcaguucgaggccgucgggcgggaguucaacaaccuggagcgccggaucgagaaccugaacaagaagauggaggacggcuuccucgacguguggaccuacaacgccgagcugcugguccucauggagaacgagcgcacccuggacuuccacgacuccaacgugaagaaccuguacgacaaggugcggcuccagcugaaggacaacgcgaaggagcuggggaacggcugcuucgaguucuaccacaagugcgacaacgagugcauggagagcguccgcaacggcaccuacgacuacccccaguacuccgaggaggcccggcucaagcgcgaggagaucagcggggugaagcuggaguccaucggcaucuaccagauccugucgaucuacuccacgguggccagcucccucgcccuggccaucauggucgcggggcugagccucuggaugugcagcaacggcucccugcagugccgcaucugcaucuga

SEQ ID NO: 2452 - RNA, 1701 nt, Artificial Sequence; identical to SEQ ID NO: 2101
  derived and/or modified CDS sequence (AUadapt) from InfluenzaA__ABX10525__HA

SEQ ID NO: 2453 - RNA, 1698 nt, Artificial Sequence; identical to SEQ ID NO: 2159
  derived and/or modified CDS sequence (AUadapt) from InfluenzaA__ABX58239__HA

SEQ ID NO: 2454 - RNA, 1698 nt, Artificial Sequence; identical to SEQ ID NO: 2259
  derived and/or modified CDS sequence (AUadapt) from InfluenzaA__ABX58250__HA

SEQ ID NO: 2455 - RNA, 1698 nt, Artificial Sequence
  derived and/or modified CDS sequence (AUadapt) from InfluenzaA__ABX58261__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggucccuccuggagcccggggacaccaucaucuucgaggcgaacggcaaccugaucgccccgcgguucgccuucgcccucagccgcggguucggcuccggcaucaucaccagcaacgcccccauggacgagugcgacgcgaagugccagacgccccagggggccaucaacuccucgcugcccuuccagaacgugcacccggucaccaucggcgagugccccaaguacgugcgguccaccaagcugcgcauggugaccgggcuccggaacauccccagcauccagucccgcggccuguucggggccaucgccggcuucaucgagggcggguggacgggcauggucgacgggugguacggcuaccaccaccagaacgagcaggggagcggcuacgccgcggaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacucggaggaguccaagcucaaccgcgagaagaucgacggcgugaagcuggagagcaugggcguguaccagauccuggcgaucuacagcacggucgccuccagccucgugcugcuggugucccucggggccaucagcuucuggaugugcuccaacggcagccugcagugccggaucugcaucuga

SEQ ID NO: 2456 - RNA, 1698 nt, Artificial Sequence
  derived and/or modified CDS sequence (AUadapt) from InfluenzaA__ABX58272__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaagaaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagucgaagcucaaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 2457 - RNA, 1698 nt, Artificial Sequence; identical to SEQ ID NO: 2159
  derived and/or modified CDS sequence (AUadapt) from InfluenzaA__ABX58283__HA

SEQ ID NO: 2458 - RNA, 1698 nt, Artificial Sequence; identical to SEQ ID NO: 2300
  derived and/or modified CDS sequence (AUadapt) from InfluenzaA__ABX58294__HA

SEQ ID NO: 2459 - RNA, 1698 nt, Artificial Sequence; identical to SEQ ID NO: 2155
  derived and/or modified CDS sequence (AUadapt) from InfluenzaA__ABX58316__HA

SEQ ID NO: 2460 - RNA, 1698 nt, Artificial Sequence; identical to SEQ ID NO: 2304
  derived and/or modified CDS sequence (AUadapt) from InfluenzaA__ABX58327__HA

SEQ ID NO: 2461 - RNA, 1698 nt, Artificial Sequence; identical to SEQ ID NO: 2155
  derived and/or modified CDS sequence (AUadapt) from InfluenzaA__ABX58338__HA

SEQ ID NO: 2462 - RNA, 1698 nt, Artificial Sequence
  derived and/or modified CDS sequence (AUadapt) from InfluenzaA__ABX58360__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcccccauccagcucgggaacugcuccgucgccggcuggauccuggggaacccggagugcgagcugcucaucagcaaggaguccuggagcuacaucguggagacccccaaccccgagaacggcacgugcuaccccggcuacuucgccgacuacgaggagcugcgcgagcagcuguccagcguguccucguucgagcgguucgagaucuucccgaaggaguccagcuggcccaaccacaccgucaccgggguguccgccagcugcucccacaacggcaagagcuccuucuaccgcaaccuccuguggcugaccgggaagaacggccucuaccccaaccugagcaaguccuacgcgaacaacaaggagaaggaggugcugguccucuggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccugcucgagcccggggacaccaucaucuucgaggcgaacggcaaccugaucgccccgcgguucgccuucgcccugucccgcggguucggcagcggcaucaucacguccaacgcccccauggacgagugcgacgcgaagugccagacgccccagggggccaucaacagcucccuccccuuccagaacguccacccggugaccaucggcgagugccccaaguacgugcggucgaccaagcugcgcauggucaccgggcugcggaacauccccuccauccagagccgcggccucuucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccugaacaagaaggucgacgacggcuuccucgacaucuggaccuacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgggugcauggagagcgugaagaacggcacguacgacuaccccaaguacuccgaggagucgaagcugaaccgcgagaagaucgacggcgugaagcucgaguccaugggggucuaccagauccuggcgaucuacagcaccguggccagcucccuggugcuccuggucagccugggcgccaucuccuucuggaugugcagcaacgggucccuccagugccggaucugcaucuga

SEQ ID NO: 2463 - RNA, 1698 nt, Artificial Sequence; identical to SEQ ID NO: 2159
  derived and/or modified CDS sequence (AUadapt) from InfluenzaA__ABX58371__HA

SEQ ID NO: 2464 - RNA, 1698 nt, Artificial Sequence; identical to SEQ ID NO: 2159
  derived and/or modified CDS sequence (AUadapt) from InfluenzaA__ABX58382__HA

SEQ ID NO: 2465 - RNA, 1698 nt, Artificial Sequence; identical to SEQ ID NO: 2300
  derived and/or modified CDS sequence (AUadapt) from InfluenzaA__ABX58393__HA

SEQ ID NO: 2466 - RNA, 1698 nt, Artificial Sequence; identical to SEQ ID NO: 2159
  derived and/or modified CDS sequence (AUadapt) from InfluenzaA__ABX58404__HA

SEQ ID NO: 2467 - RNA, 1698 nt, Artificial Sequence
  derived and/or modified CDS sequence (AUadapt) from InfluenzaA__ABX58415__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaagaaguccuggagcuacaucguggagacccccaaccccgagaacggcacgugcuaccccggcuacuucgccgacuacgaggagcugcgggagcagcucagcuccgugucguccuucgagcgcuucgagaucuucccgaaggagagcuccuggcccaaccacaccgucaccggggugagcgccuccugcagccacaacggcaaguccucguucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 2468 - RNA, 1698 nt, Artificial Sequence; identical to SEQ ID NO: 2159
  derived and/or modified CDS sequence (AUadapt) from InfluenzaA__ABX58426__HA

SEQ ID NO: 2469 - RNA, 1698 nt, Artificial Sequence; identical to SEQ ID NO: 2159
  derived and/or modified CDS sequence (AUadapt) from InfluenzaA__ABX58437__HA

SEQ ID NO: 2470 - RNA, 1698 nt, Artificial Sequence; identical to SEQ ID NO: 2155
  derived and/or modified CDS sequence (AUadapt) from InfluenzaA__ABX58448__HA

SEQ ID NO: 2471 - RNA, 1698 nt, Artificial Sequence; identical to SEQ ID NO: 2201
  derived and/or modified CDS sequence (AUadapt) from InfluenzaA__ABX58459__HA

SEQ ID NO: 2472 - RNA, 1698 nt, Artificial Sequence; identical to SEQ ID NO: 2300
  derived and/or modified CDS sequence (AUadapt) from InfluenzaA__ABX58470__HA

SEQ ID NO: 2473 - RNA, 1698 nt, Artificial Sequence; identical to SEQ ID NO: 2201
  derived and/or modified CDS sequence (AUadapt) from InfluenzaA__ABX58481__HA

SEQ ID NO: 2474 - RNA, 1698 nt, Artificial Sequence; identical to SEQ ID NO: 2159
  derived and/or modified CDS sequence (AUadapt) from InfluenzaA__ABX58492__HA

SEQ ID NO: 2475 - RNA, 1698 nt, Artificial Sequence; identical to SEQ ID NO: 2175
  derived and/or modified CDS sequence (AUadapt) from InfluenzaA__ABX58503__HA

SEQ ID NO: 2476 - RNA, 1698 nt, Artificial Sequence; identical to SEQ ID NO: 2201
  derived and/or modified CDS sequence (AUadapt) from InfluenzaA__ABX58525__HA

SEQ ID NO: 2477 - RNA, 1698 nt, Artificial Sequence
  derived and/or modified CDS sequence (AUadapt) from InfluenzaA__ABX58536__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagcccuggagcuacaucguggagacccccaaccccgagaacggcacgugcuacccgggcuacuucgccgacuacgaggagcugcgggagcagcucuccagcguguccucguucgagcgcuucgagaucuuccccaaggaguccagcuggcccaaccacaccgucaccgggguguccgccagcugcucccacaacggcaagagcuccuucuaccggaaccugcuguggcucaccgggaagaacggccuguaccccaaccugucgcgcuccuacgccaacaacaaggagaaggaggugcucguccuguggggcgugcaccacccgcccaacaucggggaccagcgggcccuguaccacacggagaacgccuacgugagcgucguguccagccacuacagccgccgguucacccccgagaucgccaagcgccccaaggugcgggaccaggagggccgcaucaacuacuacuggacccuccuggagccgggggacaccaucaucuucgaggcgaacggcaaccugaucgcgccccgguucgccuucgcccucucccgcggguucggcucgggcaucaucacguccaacgcccccauggacgagugcgacgccaagugccagacgccccagggggccaucaacagcucccugccguuccagaacguccaccccgugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacucggucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuacccgaaguacuccgaggagagcaagcucaaccgcgagaagaucgacggcgugaagcuggaguccaugggcgucuaccagauccuggccaucuacucgacgguggccuccagccucgugcugcuggucagccucggggccaucuccuucuggaugugcagcaacggcucccugcagugccggaucugcaucuga

SEQ ID NO: 2478 - RNA, 1698 nt, Artificial Sequence
  derived and/or modified CDS sequence (AUadapt) from InfluenzaA__ABX58547__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgugaccggggucuccgccagcugcucccacaacggcaagucguccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagacccgcggccuguucggggccaucgccggcuucaucgagggcggguggaccggcauggucgacgggugguacggcuaccaccaccagaacgagcaggggucgggcuacgccgcggaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuuccuggacaucuggaccuacaacgccgagcugcucguccugcuggagaacgagcggacgcucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggcgaucuacuccaccgucgccagcagccucgugcugcuggugucccucggggccaucagcuucuggaugugcuccaacggcagccugcagugccggaucugcaucuga

SEQ ID NO: 2479 - RNA, 1698 nt, Artificial Sequence
  derived and/or modified CDS sequence (AUadapt) from InfluenzaA__ABX58558__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggccgcagcuccuucuaccggaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacgccuacgugucggucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacaagugcgacgcgaagugccagacgccccagggggccaucaacagcucccugcccuuccagaacguccacccggugaccaucggcgagugccccaaguacgugcgcucgaccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 2480 - RNA, 1698 nt, Artificial Sequence
  derived and/or modified CDS sequence (AUadapt) from InfluenzaA__ABX58569__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgccaccgggguguccgccagcugcucccacaacggcaagucguccuucuaccgcaaccugcuguggcucaccgggaagaacggccuguaccccaaccugagcaaguccuacgccaacaacaaggagaaggagguccucgugcuguggggcgugcaccacccgcccaacaucggggaccagcgggcccuguaccacacggagaacgccuacgucagcguggugagcucccacuacucgcgccgguucacccccgagaucgcgaagcgccccaagguccgggaccaggagggccgcaucaacuacuacuggacccuccuggagcccggggacaccaucaucuucgaggccaacggcaaccugaucgccccgcgguucgccuucgcccucucccgcggguucggcagcggcaucaucacguccaacgcgcccauggacgagugcgacgccaagugccagacgccccagggggccaucaacagcucccugcccuuccagaacgugcacccggugaccaucggcgagugccccaaguacguccggagcaccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgcgaaggagaucgggaacggcugcuucgaguucuaccacaagugcaacgacgagugcauggagagcgugaagaacgggacguacgacuaccccaaguacuccgaggagucgaagcucaaccgcgagaagaucgacggcgucaagcuggaguccaugggcguguaccagauccuggccaucuacagcaccguggccagcucccucguccugcuggugagccucggggccaucuccuucuggaugugcagcaacggcucccugcagugccggaucugcaucuga

SEQ ID NO: 2481 - RNA, 1698 nt, Artificial Sequence; identical to SEQ ID NO: 2155
  derived and/or modified CDS sequence (AUadapt) from InfluenzaA__ABX58580__HA

SEQ ID NO: 2482 - RNA, 1698 nt, Artificial Sequence; identical to SEQ ID NO: 2159
  derived and/or modified CDS sequence (AUadapt) from InfluenzaA__ABX58591__HA

SEQ ID NO: 2483 - RNA, 1698 nt, Artificial Sequence
  derived and/or modified CDS sequence (AUadapt) from InfluenzaA__ABX58602__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcuggagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagccccgggacaccaucaucuucgaggcgaacgggaaccugaucgccccgcgcuucgccuucgcccucucccggggcuucgggagcggcaucaucacguccaacgcccccaugggcgagugcgacgcgaagugccagacgccccagggggccaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 2484 - RNA, 1698 nt, Artificial Sequence; identical to SEQ ID NO: 2192
  derived and/or modified CDS sequence (AUadapt) from InfluenzaA__ABX58613__HA

SEQ ID NO: 2485 - RNA, 1698 nt, Artificial Sequence; identical to SEQ ID NO: 2159
  derived and/or modified CDS sequence (AUadapt) from InfluenzaA__ABX58624__HA

SEQ ID NO: 2486 - RNA, 1698 nt, Artificial Sequence
  derived and/or modified CDS sequence (AUadapt) from InfluenzaA__ABX58635__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggccgcagcuccuucuaccggaaccugcuguggcucaccgggaagaacggccuguaccccagccuguccaagucguacgccaacaacaaggagaaggaggugcucguccuguggggcgugcaccacccgcccaacaucggggaccagcgcgcccuguaccacacggagaacgccuacgugagcgucguguccagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucagccggggguucggcuccggcaucaucacgagcaacgcccccauggacgagugcgacgcgaagugccagacgccccagggggccaucaacuccucgcugcccuuccagaacguccacccggugaccaucggcgagugccccaaguacgugcgcuccaccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacucggaggaguccaagcucaaccgggagaagaucgacggcgugaagcuggagagcaugggcgucuaccagauccuggcgaucuacagcaccguggccuccagccucgugcugcuggucucccucggggccaucagcuucuggaugugcuccaacggcagccugcagugccgcaucugcaucuga

SEQ ID NO: 2487 - RNA, 1698 nt, Artificial Sequence; identical to SEQ ID NO: 2155
  derived and/or modified CDS sequence (AUadapt) from InfluenzaA__ABX58679__HA

SEQ ID NO: 2488 - RNA, 1698 nt, Artificial Sequence; identical to SEQ ID NO: 2201
  derived and/or modified CDS sequence (AUadapt) from InfluenzaA__ABX58701__HA

SEQ ID NO: 2489 - RNA, 1698 nt, Artificial Sequence; identical to SEQ ID NO: 2259
  derived and/or modified CDS sequence (AUadapt) from InfluenzaA__ABX58712__HA

SEQ ID NO: 2490 - RNA, 1704 nt, Artificial Sequence
  derived and/or modified CDS sequence (AUadapt) from InfluenzaA__ABY19417__HA
auggagaagaucgugcugcuccuggccaucaucucgcuggucaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguucaucaacguccccgaguggagcuacaucguggagaaggccaaccccgccaacgaccugugcuaccccgggaacuucaacgacuacgaggagcugaagcaccuccugucccggaucaaccacuucgagaagauccagaucauccccaagucguccuggagcgaccacgaggccuccucgggcguguccagcgcgugcccguaccagggcguccccuccuucuuccgcaacgugguguggcugaucaagaagaacaacaccuaccccacgaucaagcggucguacaacaacaccaaccaggaggaccuccugauccugugggggauccaccacuccaacgacgccgccgagcagaccaagcucuaccagaacccgaccacguacaucagcgucggcaccuccacccugaaccagcgccuggugcccaagaucgccacccggucgaaggugaacgggcaguccggccgcauggacuucuucuggacgauccucaagcccaacgacgcgaucaacuucgagagcaacgggaacuucaucgcccccgaguacgccuacaagaucgucaagaagggcgacucggccaucaugaaguccgagguggaguacggcaacugcaacaccaagugccagaccccgaucggggccaucaacagcuccaugcccuuccacaacauccacccccugaccaucggcgagugccccaaguacgucaagucgaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagucgacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucaaguucuaccacaagugcgacaacgagugcauggaguccgugcggaacggcaccuacgacuacccccaguacucggaggaggcccgccucaagcgggaggagaucuccggggugaagcuggagagcaucggcaccuaccagauccuguccaucuacucgacggucgcguccagccucgcccuggccaucaugguggccgggcugucccucuggaugugcucgaacggcagccugcagugccgcauccgcaucuga

SEQ ID NO: 2491 - RNA, 1704 nt, Artificial Sequence
  derived and/or modified CDS sequence (AUadapt) from InfluenzaA__ABY19418__HA
auggagaagaucgugcugcuccuggccaucaucucgcuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguucaucaacguccccgaguggucguacaucguggagaaggccaaccccgccaacgaccugugcuaccccggggacuucaacgacuacgaggagcugaagcaccuccugucccggaucaaccacuucgagaagauccagaucauccccaagagcuccuggucggaccacgaggccuccagcggcguguccucggcgugcccguaccagggcguccccuccuucuuccgcaacgugguguggcugaucaagaagaacaacaccuaccccacgaucaagcggagcuacaacaacaccaaccaggaggaccuccugauccugugggggauccaccacuccaacgacgccgccgagcagaccaagcucuaccagaacccgaccacguacaucagcgucggcaccuccacccugaaccagcgccuggugcccaagaucgccacccggucgaaggugaacgggcaguccggccgcauggacuucuucuggacgauccucaagcccaacgacgcgaucaacuucgagagcaacgggaacuucaucgcccccgaguacgccuacaagaucgucaagaagggcgacucggccaucaugaaguccgagguggaguacggcaacugcaacaccaagugccagaccccgaucggggccaucaacagcuccaugcccuuccacaacauccacccccugaccaucggcgagugccccaaguacgucaagucgaacaagcuggugcucgcgacggggcugcggaacuccccgcugcgcgagcggcgccggaagcgcggccucuucggcgccaucgccggguucaucgagggcggguggcagggcaugguggacgggugguacggcuuccaccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacucgaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagucgaucggcaccuaccagauccuguccaucuacagcacggucgcguccucgcucgcccuggccaucaugguggccgggcugucccucuggaugugcagcaacggcagccugcagugccgcaucugcaucuga

SEQ ID NO: 2492 - RNA, 1704 nt, Artificial Sequence
  derived and/or modified CDS sequence (AUadapt) from InfluenzaA__ABY19419__HA
auggagaagaucgugcugcuccuggccaucaucucgcuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguucaucaacguccccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcguguccucggcgugcccguaccagggcguccccuccuucuuccgcaacgugguguggcugaucaagaagaacaacaccuaccccacgaucaagcggagcuacaacaacaccaaccaggaggaccuccugauccugugggggauccaccacuccaacgacgccgccgagcagaccaagcucuaccagaacccgaccacguacaucucggucggcaccuccacccugaaccagcgccuggugcccaagaucgccacccggagcaaggugaacgggcaguccggccgcauggacuucuucuggacgauccucaagcccaacgacgcgaucaacuucgagucgaacgggaacuucaucgcccccgaguacgccuacaagaucgucaagaagggcgacagcgccaucaugaaguccgagguggaguacggcaacugcaacaccaagugccagaccccgaucggggccaucaacucguccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacucgaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacucgaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagucgaucggcaccuaccagauccuguccaucuacagcacggucgcguccucgcucgcccuggccaucaugguggccgggcugucccucuggaugugcagcaacggcagccugcagugccgcaucugcaucuga

SEQ ID NO: 2493 - RNA, 1698 nt, Artificial Sequence; identical to SEQ ID NO: 2300
  derived and/or modified CDS sequence (AUadapt) from InfluenzaA__ABY51017__HA

SEQ ID NO: 2494 - RNA, 1701 nt, Artificial Sequence; identical to SEQ ID NO: 2173
  derived and/or modified CDS sequence (AUadapt) from InfluenzaA__ABY51028__HA

SEQ ID NO: 2495 - RNA, 1698 nt, Artificial Sequence
  derived and/or modified CDS sequence (AUadapt) from InfluenzaA__ABY51039__HA
augaaggugaagcugcucguccugcugugcaccuucaccgccacgaacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagacccccaaccccgagaacggcacgugcuaccccggccacuucgccgacuacgaggagcugcgcgagcagcucuccagcguguccucguucgagcgguucgagaucuucccgaaggaguccagcuggcccaaccacaccgucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugagcgucgugucgucccacuacagccggaaguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcucgggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaaggggcagcugaagaacaacgcgaaggagaucggcaacgggugcuucgaguucuaccacaagugcaacgacgagugcauggaguccgugaagaacggcaccuacgacuaccccaaguacucggaggaguccaagcugaaccgcgagaagaucgacggcgugaagcucgagagcaugggggucuaccagauccuggccaucuacuccaccguggccagcucgcuggugcuccuggucucccugggcgccaucagcuucuggaugugcuccaacgggagccuccagugccggaucugcaucuga

SEQ ID NO: 2496 - RNA, 1698 nt, Artificial Sequence
  derived and/or modified CDS sequence (AUadapt) from InfluenzaA__ABY51050__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugucgucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacucgaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggcgaucuacucgaccguggccuccagccuggugcuccuggucucccugggggccaucagcuucuggaugugcuccaacggcagccuccagugccggaucugcaucuga

SEQ ID NO: 2497 - RNA, 1698 nt, Artificial Sequence; identical to SEQ ID NO: 2259
  derived and/or modified CDS sequence (AUadapt) from InfluenzaA__ABY51061__HA

SEQ ID NO: 2498 - RNA, 1698 nt, Artificial Sequence
  derived and/or modified CDS sequence (AUadapt) from InfluenzaA__ABY51072__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugucgguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggucgaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggccuucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggacguacgacuaccccaaguacuccgaggagucgaagcucaaccgcgagaagaucgacggcgugaagcuggaguccaugggcguguaccagauccuggccaucuacagcaccgucgccagcucccucgugcugcuggugagccucggggccaucuccuucuggaugugcagcaacggcucccugcagugccggaucugcaucuga

SEQ ID NO: 2499 - RNA, 1698 nt, Artificial Sequence; identical to SEQ ID NO: 2201
  derived and/or modified CDS sequence (AUadapt) from InfluenzaA__ABY51083__HA

SEQ ID NO: 2500 - RNA, 1698 nt, Artificial Sequence; identical to SEQ ID NO: 2159
  derived and/or modified CDS sequence (AUadapt) from InfluenzaA__ABY51094__HA

SEQ ID NO: 2501 - RNA, 1698 nt, Artificial Sequence; identical to SEQ ID NO: 2300
  derived and/or modified CDS sequence (AUadapt) from InfluenzaA__ABY51105__HA

SEQ ID NO: 2502 - RNA, 1698 nt, Artificial Sequence; identical to SEQ ID NO: 2159
  derived and/or modified CDS sequence (AUadapt) from InfluenzaA__ABY51116__HA

SEQ ID NO: 2503 - RNA, 1701 nt, Artificial Sequence
  derived and/or modified CDS sequence (AUadapt) from InfluenzaA__ABY51127__HA
augaagaccaucaucgcccugucguacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcgacucgccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagguguuccucuacgcgcaggccucggggcggaucaccguguccacgaagcgcagccagcagaccgucaucccgaacaucggcucgcggccccgcgugcggaacauccccucccgcaucagcaucuacuggaccaucgugaagcccggcgacauccugcugaucaacuccaccgggaaccucaucgccccgcggggcuacuucaagauccgcucggggaaguccagcaucaugcgguccgacgcccccaucggcaagugcaacucggagugcaucacgcccaacggcuccauccccaacgacaagccguuccagaacgucaaccgcaucaccuacggggccugcccccgguacgugaagcagaacacccugaagcuggcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccucaaguccacccaggcggccaucgaccagaucaacgggaagcugaaccggcugaucggcaagaccaacgagaaguuccaccagaucgagaaggaguucucggagguggagggccgcauccaggaccucgagaaguacguggaggacaccaagaucgaccugugguccuacaacgccgagcugcucgucgcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaaggggguggagcucaagucgggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 2504 - RNA, 1698 nt, Artificial Sequence
  derived and/or modified CDS sequence (AUadapt) from InfluenzaA__ABY51138__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugucguccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccugucccgcucguacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccucgcugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagauccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccuccagccucgugcugcuggucagccucggggccaucuccuucuggaugugcagcaacggcucccugcagugccggaucugcaucuga

SEQ ID NO: 2505 - RNA, 1698 nt, Artificial Sequence; identical to SEQ ID NO: 2159
  derived and/or modified CDS sequence (AUadapt) from InfluenzaA__ABY51149__HA

SEQ ID NO: 2506 - RNA, 1698 nt, Artificial Sequence
  derived and/or modified CDS sequence (AUadapt) from InfluenzaA__ABY51160__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugucguccuucgagcgcuucgagaucuucccgaaggagagcuccuggcccaaccacaccgucaccggggugagcgccuccugcagccacaacggcaaguccucguucuaccggaaccugcuguggcucaccgggaagaacggccuguaccccaaccuguccaagagcuacgccaacaacaaggagaaggaggugcucguccuguggggcgugcaccacccgcccaacaucggggaccagcgcgcccuguaccacacggagaacgccuacguguccgucgugagcagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucgcggggguucggcuccggcaucaucacgagcaacgcccccauggacaagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugaucgacgggugguacggcuaccaccaccagaacgagcaggggucgggcuacgcggccgaccagaaguccacccagaacgccaucaacggcaucaccaacaaggugaacagcgugaucgagaagaugaacacccaguucacggccgucgggaaggaguucaacaagcuggagcgccggauggagaaccucaacaagaagguggacgacggcuuccuggacaucuggaccuacaacgccgagcugcucguccugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagucgaugggcguguaccagauccuggccaucuacuccacggucgccagcagccucgugcugcuggugucccucggggccaucagcuucuggaugugcuccaacggcagccugcagugccgcaucugcaucuga

SEQ ID NO: 2507 - RNA, 1698 nt, Artificial Sequence
  derived and/or modified CDS sequence (AUadapt) from InfluenzaA__ABY51171__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccagaaguacuccgaggagucgaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 2508 - RNA, 1698 nt, Artificial Sequence; identical to SEQ ID NO: 2155
  derived and/or modified CDS sequence (AUadapt) from InfluenzaA__ABY51182__HA

SEQ ID NO: 2509 - RNA, 1698 nt, Artificial Sequence; identical to SEQ ID NO: 2175
  derived and/or modified CDS sequence (AUadapt) from InfluenzaA__ABY51193__HA

SEQ ID NO: 2510 - RNA, 1698 nt, Artificial Sequence; identical to SEQ ID NO: 2159
  derived and/or modified CDS sequence (AUadapt) from InfluenzaA__ABY51237__HA

SEQ ID NO: 2511 - RNA, 1698 nt, Artificial Sequence; identical to SEQ ID NO: 2175
  derived and/or modified CDS sequence (AUadapt) from InfluenzaA__ABY51248__HA

SEQ ID NO: 2512 - RNA, 1698 nt, Artificial Sequence; identical to SEQ ID NO: 2155
  derived and/or modified CDS sequence (AUadapt) from InfluenzaA__ABY51259__HA

SEQ ID NO: 2513 - RNA, 1701 nt, Artificial Sequence; identical to SEQ ID NO: 2232
  derived and/or modified CDS sequence (AUadapt) from InfluenzaA__ABY51270__HA

SEQ ID NO: 2514 - RNA, 1707 nt, Artificial Sequence
  derived and/or modified CDS sequence (AUadapt) from InfluenzaA__ABY76282__HA
auggagaagaucgugcugcuccuggccaucgucucgcuggugaaguccgaccagaucugcaucggcuaccacgccaacaacucgaccgagcacguggacaccaucauggagaagaacgucacggugacccacgcgcaggacauccucgagaaggcccacaacgggcgccugugcgaccuggacggcgugaagccccucauccugcgggacugcuccgucgccggguggcugcucggcaacccgaugugcgacgaguuccugaacgugcccgaguggagcuacaucguggagaagaacaaccccgccaacgaccugugcuaccccgggaacuucaacgacuacgaggagcucaagcaccuccugucccgcaucaaccacuucgagaagauccagaucauccccaagucguccuggucggaccacgaggccuccagcggcgucuccucggcgugcccguaccagggccgguccagcuucuuccgcaacgugguguggcugaucaagaagaacgacgccuaccccaccaucaagcgguccuacaacaacaccaaccaggaggaccugcugguccucugggggauccaccaccccaacgacgccgccgagcagacgcgccuguaccagaacccgaccaccuacaucucggugggcaccuccacgcugaaccagcggcucgugcccaagaucgcgacccgcucgaaggucaacgggcaguccggccggauggaguucuucuggaccauccugaagcccaacgacgccaucaacuucgagagcaacgggaacuucaucgcccccgagaacgccuacaagaucgugaagaagggcgacucgaccaucaugaaguccgagcuggaguacggcaacugcaacacgaagugccagaccccgaucggggccaucaacagcuccaugcccuuccacaacauccacccccucaccaucggcgagugccccaaguacgucaagucgaaccgccuggugcuggcgaccgggcuccggaacuccccgcagggcgagcgccggcgcaagaagcggggccuguucggggccaucgccggcuucaucgagggcggguggcaggggaugguggacggcugguacggcuaccaccacucgaacgagcagggguccggcuacgccgccgacaaggagagcacgcagaaggcgaucgacggggugaccaacaaggucaacuccaucaucgacaagaugaacacccaguucgaggccgugggccgcgaguucaacaaccuggagcggcgcaucgagaaccucaacaagaagauggaggacggguuccuggacguguggaccuacaacgccgagcugcucguccugauggagaacgagcggacgcuggacuuccacgacucgaacgugaagaaccucuacgacaagguccgccugcagcugcgggacaacgccaaggagcucggcaacggcugcuucgaguucuaccaccgcugcgacaacgagugcauggaguccgugcgcaacgggaccuacgacuacccccaguacagcgaggaggcccggcugaagcgcgaggagaucuccggcgugaagcuggagucgaucgggaccuaccagauccucuccaucuacucgaccgucgcguccagccuggcccuggccaucaugguggccggccucucccuguggaugugcucgaacgggagccugcagugccggaucugcaucuga

SEQ ID NO: 2515 - RNA, 1701 nt, Artificial Sequence
  derived and/or modified CDS sequence (AUadapt) from InfluenzaA__ABY81349__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcucgaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugucguccgugagcuccuucgagcgcuucgagaucuuccccaaggagcggagcuggccgaagcacaacgucacccgcggggugacggccgccugcucccacaagggcaagucguccuucuaccggaaccuccuguggcugaccgagaagaacgggagcuaccccaaccucuccaagagcuacgugaacaacaaggagaaggagguccuggugcuguggggcgugcaccaccccucgaacaucaaggaccagaagaccaucuaccagaaggagaacgcguacgucuccguggugagcuccaacuacaaccgccgguucacccccgagaucgccaagcgcccgaagguccgggaccaggaggggcgcaucaacuacuacuggacgcuccuggagcccggcgacaccaucaucuucgaggccaacggcaaccugaucgcccccugguacgccuucgcgcucagccggggguucggcuccgggaucaucaccucgaacgccuccauggacgagugcgacaccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagucgcggggccuguucggggccaucgccggcuucaucgagggcggcuggacgggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagaagcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggucaagucccagcugaagaacaacgcgaaggagguggggaacggcugcuucgaguucuaccacaagugcaacaacgagugcauggagucggugaagaacgggaccuacgacuacccgaaguacuccgaggagagcaagcucaaccgcgagaagaucgacggcgucaagcuggagagcauggggguguaccagauccuggccaucuacuccacgguggccucgucccucguccugcuggugagccucggcgccaucuccuucuggaugugcagcaacggcucccugcagugccggaucugcaucuga

SEQ ID NO: 2516 - RNA, 1701 nt, Artificial Sequence; identical to SEQ ID NO: 2173
  derived and/or modified CDS sequence (AUadapt) from InfluenzaA__ABY81371__HA

SEQ ID NO: 2517 - RNA, 1698 nt, Artificial Sequence; identical to SEQ ID NO: 2159
  derived and/or modified CDS sequence (AUadapt) from InfluenzaA__ABY81382__HA

SEQ ID NO: 2518 - RNA, 1698 nt, Artificial Sequence; identical to SEQ ID NO: 2201
  derived and/or modified CDS sequence (AUadapt) from InfluenzaA__ABY81393__HA

SEQ ID NO: 2519 - RNA, 1698 nt, Artificial Sequence
  derived and/or modified CDS sequence (AUadapt) from InfluenzaA__ABY81415__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccucccccgagaacggcacgugcuaccccggcuacuucgccgacuacgaggagcugcgcgagcagcucagcuccgugucguccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagucguacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccaugggggagugcgacgcgaagugccagacgccccagggcgccaucaacuccucgcugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacucggaggaguccaagcucaaccgcgagaagaucgacggcgugaagcuggagagcaugggggucuaccagauccuggccaucuacagcacgguggccuccagccucgugcugcuggucucccucggcgccaucagcuucuggaugugcuccaacgggagccugcagugccggaucugcaucuga

SEQ ID NO: 2520 - RNA, 1701 nt, Artificial Sequence; identical to SEQ ID NO: 2173
  derived and/or modified CDS sequence (AUadapt) from InfluenzaA__ACA24502__HA

SEQ ID NO: 2521 - RNA, 1698 nt, Artificial Sequence
  derived and/or modified CDS sequence (AUadapt) from InfluenzaA__ACA24513__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucaacuccgugucguccuucgagcgguucgagaucuucccgaaggagagcuccuggcccaaccacaccgugaccggggucagcgccuccugcagccacaacggcaaguccucguucuaccgcaaccugcuguggcucaccgggaagaacggccuguaccccaaccuguccaagagcuacgccaacaacaaggagaaggaggugcucgugcuguggggcguccaccacccgcccaacaucggggaccagcgggcccuguaccacacggagaacgccuacguguccguggucagcagccacuacucccgccgguucacccccgagaucgccaagcgccccaaggugcgggaccaggagggccgcaucaacuacuacuggacccuccuggagccccgggacaccaucaucuucgaggcgaacgggaaccugaucgccccgcgcuucgccuucgcccucucgcggggcuucggguccggcaucaucacgagcaacgcccccauggacgagugcgacgcgaagugccagacgccccagggcgccaucaacuccagccugcccuuccagaacgugcacccggucaccaucggggagugccccaaguacgugcgcuccaccaagcugcggauggugaccggccuccgcaacauccccagcauccagucccgggggcuguucggcgccaucgccggguucaucgagggcggcuggaccgggauggucgacggcugguacggguaccaccaccagaacgagcagggcucgggguacgccgcggaccagaaguccacccagaacgccaucaacggcaucaccaacaaggugaacagcgugaucgagaagaugaacacgcaguucaccgccgucggcaaggaguucaacaagcuggagcgccggauggagaaccucaacaagaagguggacgacggguuccuggacaucuggaccuacaacgccgagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgggagaagaucgacggggugaagcuggagucgaugggcguguaccagauccuggcgaucuacuccaccgucgccagcagccucgugcugcuggugucccucggcgccaucagcuucuggaugugcuccaacgggagccugcagugccgcaucugcaucuga

SEQ ID NO: 2522 - RNA, 1698 nt, Artificial Sequence; identical to SEQ ID NO: 2159
  derived and/or modified CDS sequence (AUadapt) from InfluenzaA__ACA24524__HA

SEQ ID NO: 2523 - RNA, 1701 nt, Artificial Sequence
  derived and/or modified CDS sequence (AUadapt) from InfluenzaA__ACA24689__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagaucaucgacggggagaacugcacccucaucgacgcccugcugggcgacccccagugcgacggcuuccagaacaagaagugggaccucuucguggagcgcuccaaggccuacucgaacugcuaccccuacgacgugccggacuacgcgucccugcggagccuggucgccuccucggggacgcucgaguucaacaacgaguccuucaacuggaccggcgugacccagaacgggaccagcuccgccugcaagcgcggcucgaacaacuccuucuucagccggcugaacuggcugacgcacuccaaguucaaguaccccgcccucaacgugaccaugcccaacaacgaggaguucgacaagcuguacaucuggggcguccaccaccccgggaccgacaacgaccagaucuuccuguacgcgcaggccucgggccgcaucaccguguccacgaagcggagccagcagaccgugaucccgaacaucgggucgcgcccccggguccgcaacauccccucccggaucagcaucuacuggaccaucgugaagcccggcgacauccuccugaucaacuccaccgggaaccugaucgccccgcgcggcuacuucaagauccggucgggcaaguccagcaucaugcgcuccgacgcccccaucgggaagugcaacucggagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccugaaguccacccaggcggccaucgaccagaucaacggcaagcucaaccgccugaucgggaagaccaacgagaaguuccaccagaucgagaaggaguucucggaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacuacgucuaccgcgacgaggcccugaacaaccgcuuccagaucaagggcaucgagcucaagucgggguacaaggacuggauccuguggaucuccuucgccaucagcugcuuccugcugugcguggcccuccugggcuucaucaugugggccugccagaaggggaacauccggugcaacaucugcaucuga

SEQ ID NO: 2524 - RNA, 1701 nt, Artificial Sequence
  derived and/or modified CDS sequence (AUadapt) from InfluenzaA__ACA24700__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcucccaggccuacucgaacugcuaccccuacgacgugccggacuacgcgucccugcggagccucgucgccuccucggggacgcuggaguucaacaacgaguccuucaacuggaccggcgugacccagaacgggaccagcuccgccugcaagcgcggcucgaacaacuccuucuucucgcggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagcggucgcagcagaccgugaucccgaacaucgggagccgcccccggguccgcaacauccccucccggaucucgaucuacuggaccaucgugaagcccggcgacauccugcugaucaacuccaccgggaaccucaucgccccgcgcggcuacuucaagauccggagcggcaaguccucgaucaugcgcuccgacgcccccaucgggaagugcaacucggagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagucgggguacaaggacuggauccuguggaucuccuucgccaucagcugcuuccugcucugcguggcccugcugggcuucaucaugugggccugccagaaggggaacauccggugcaacaucugcaucuga

SEQ ID NO: 2525 - RNA, 1698 nt, Artificial Sequence
  derived and/or modified CDS sequence (AUadapt) from InfluenzaA__ACA28846__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcauccagaaggcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 2526 - RNA, 1701 nt, Artificial Sequence
  derived and/or modified CDS sequence (AUadapt) from InfluenzaA__ACA33749__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucguccugcauccgccggagcaacaacuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcccaggcguccgggcggaucaccgugagcacgaagcgcucgcagcagaccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgccugcaucgggagcauccgcaacggcaccuacgaccacgacgucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 2527 - RNA, 1698 nt, Artificial Sequence; identical to SEQ ID NO: 2155
  derived and/or modified CDS sequence (AUadapt) from InfluenzaA__ACA96519__HA

SEQ ID NO: 2528 - RNA, 1659 nt, Artificial Sequence
  derived and/or modified CDS sequence (AUadapt) from InfluenzaA__ACC55270__HA
augaauacccaaauccuggccuucaucgccugcgugcucaccggcgucaagggggacaagaucugccugggccaccacgcgguggccaaugggacgaaggugaacacccugaccgagcgcggcaucgaggucgugaacgccaccgagacgguggagaccaccaacaucaagaagaucugcacccaggggaagcggcccacggaccucggccaaugcggccugcuggggacccucaucggcccgccccagugugaccaguuccuggaguucagcuccgaccugaucaucgagcgccgggaggggaccgacaucuguuaccccggccgcuucaccaacgaggagagccuccggcagauccugcgccgguccgggggcaucggcaaggagagcaugggguucacguauuccggcauccgcaccaacggggccaccagcgccugcacccgguccggcagcuccuucuacgcggagaugaaguggcugcucaguaacuccgacaacgccgccuucccccaaaugacgaaggccuaccgcaacccgcggaauaagcccgcgcugaucaucuggggcguccaccacagcgaguccgugagcgagcagaccaagcuguacggguccggcaacaagcucaucaccgugcgcaguuccaaguaccagcagagcuucacccccaaccccggggcccggcgcaucgacuuccauuggcugcugcucgacccgaacgacacggucaccuucaccuucaacggcgccuuuaucgcccccgaccggaccuccuucuuccgcggggagagccugggcgugcagagcgacgcgccccuggauuccagcugccggggcgacugcuuccacuccgggggcacgaucgugagcucccuccccuuucaaaacaucaacagccgcaccgucgggaagugcccgcgguacgugaagcagaagucccugcugcucgccaccggcaugcgcaacgugcccgagaagcccaagccccgggggcuguuuggcgccaucgccggcuucaucgagaacgggugggagggccugaucaacgggugguacggcuuccgccaccagaaugcccagggggagggcaccgccgcggacuacaaaagcacgcaguccgccaucgaccagaucaccggcaagcucaaccgccugaucgggaagaccaaccagcaguuugagcugaucgacaacgaguucaacgagaucgagcagcagaucggcaacgucaucaacuggacccgggaugccaugacggaaaucuggagcuacaacgccgagcuccugguggccauggagaaccagcacaccaucgaccuggcggauuccgagaugagcaagcucuacgagcgcgugaagaagcagcugcgggagaacgccgaggaggacgggaccggcugcuucgaaaucuuucacaagugcgacgaccagugcauggaguccauccgcaacaauaccuacgaccacacgcaguaccggaccgagagccugcagaaccgcauccagaucgauccggucaagcucuccagcggcuacaaggacaucauccugugguucuccuucggggccagcuguuuccugcuccuggccaucgccaugggccugguguucaucugcaucaagaacgggaacaugcagugcaccaucugcaucuga

SEQ ID NO: 2529 - RNA, 1698 nt, Artificial Sequence; identical to SEQ ID NO: 2159
  derived and/or modified CDS sequence (AUadapt) from InfluenzaA__ACC61964__HA

SEQ ID NO: 2530 - RNA, 1698 nt, Artificial Sequence
  derived and/or modified CDS sequence (AUadapt) from InfluenzaA__ACC61975__HA
augaaggugaagcugcucguccugcugugcaccuucaccgccucguacgccgacacgaucugcaucggcuaccacgcgaacaacuccaccgacaccguggacaccgugcucgagaagaacgucacggugacccacagcgugaaccugcuggaggacucccacaacgggaagcucugccugcugaagggcaucgcgccccuccagcuggggaacugcagcgucgccggcuggauccuggggaacccggagugcgagcuccugaucuccaaggagagcugguccuacaucguggaggugcccaaccccgagaacgggaccugcuaccccggcuacuucgccgacuacgaggagcugcgcgagcagcucagcuccaucucguccuucgagcgguucgagaucuucccgaaggagagcuccuggcccaaccacaccgucacgggggugagcgccuccugcagccacaacggcaaguccagcuucuaccgcaaccugcuguggcucaccgggaagaacggccuguaccccaaccuguccaagucguacgccaacaacaaggagaaggaggugcucguccuguggggcgugcaccacccgcccaacaucggcgaccagcgggcccuguaccacaccgagaacgccuacgugagcgucguguccagccacuacucccgccgguucacccccgagaucgccaagcgccccaaggugcgggaccaggagggccgcaucaacuacuacuggacgcuccuggagcccggggacaccaucaucuucgaggcgaacggcaaccugaucgccccgcgguucgccuucgcccucagccgcgggcugggcuccggcaucaucaccagcaacgcccccauggacgagugcgacgcgaagugccagacgccccagggggccaucaacuccucgcugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcucgagcggcgcauggagaaccugaacaagaaggucgacgacggcuuccuggacaucuggaccuacaacgccgagcuccuggugcugcucgagaacgagcggacgcuggacuuccacgacuccaacgugaagaaccuguacgagaaggucaagagccagcucaagaacaacgcgaaggagaucgggaacggcugcuucgaguucuaccacaagugcaacaacgagugcauggaguccgugaagaacgggaccuacgacuaccccaaguacucggaggaguccaagcugaaccgcgagaagaucgacggcgugaagcuggagagcaugggcgucuaccagauccucgccaucuacagcaccguggccuccagccuggugcugcucgucucccugggggccaucagcuucuggaugugcuccaacggcagccugcagugccggaucugcaucuga

SEQ ID NO: 2531 - RNA, 1698 nt, Artificial Sequence; identical to SEQ ID NO: 2155
  derived and/or modified CDS sequence (AUadapt) from InfluenzaA__ACC61986__HA

SEQ ID NO: 2532 - RNA, 1698 nt, Artificial Sequence
  derived and/or modified CDS sequence (AUadapt) from InfluenzaA__ACD37430__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccucguucgagcgguucgagaucuucccgaaggaguccagcuggcccacccacaccgugaccggggucuccgccagcugcucccacaacggcaagagcuccuucuaccgcaaccugcuguggcucacggggaagaacggccuguaccccaaccugagcaaguccuacgugaacaacaaggagaaggaggugcucguccuguggggcgugcaccacccgcccaacaucggggaccagcgggcccuguaccacaccgagaacgccuacgugucggucgugagcucccacuacagccgccgguucacccccgagaucgccaagcgccccaaggugcgggaccaggagggccgcaucaacuacuacuggacccuccuggagcccggggacacgaucaucuucgaggcgaacggcaaccugaucgccccgugguacgccuucgcccucucccggggguucggcagcggcaucaucaccuccaacgcccccauggacgagugcgacgcgaagugccagacgccccagggggccaucaacagcucccugcccuuccagaacguccacccggugaccaucggcgagugccccaaguacgugcgcucggccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggacguacgacuaccccaaguacuccgaggagucgaagcucaaccgggagaagaucgacggcgugaagcuggaguccaugggcgucuaccagauccuggccaucuacagcaccguggccagcucccucgugcugcuggucagccucggggccaucuccuucuggaugugcagcaacggcucccugcagugccgcaucugcaucuga

SEQ ID NO: 2533 - RNA, 1698 nt, Artificial Sequence
  derived and/or modified CDS sequence (AUadapt) from InfluenzaA__ACD37507__HA
augaaggccaagcugcucgugcugcugugcaccuucgccgcgaccuacgccgacacgaucugcaucggcuaccacgccaacaacucgaccgacaccgucgacaccgugcucgagaagaacgugacggucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggucguacaucgucgagaagcccaaccccgagaacgggaccugcuaccccggccacuucgccgacuacgaggagcugcgcgagcagcucuccagcguguccagcuucgagcgguucgagaucuucccgaaggaguccucguggcccaaccacaccgugacgggggucuccgccagcugcucccacaacggcgagagcuccuucuaccgcaaccugcuguggcucaccgggaagaacggccuguaccccaaccugucgaaguccuacgccaacaacaaggagaaggaggugcucgugcuguggggcguccaccacccgcccaacaucggcaaccagaaggcccuguaccacaccgagaacgcguacgugagcguggucagcucccacuacucgcggaaguucacccccgagaucgccaagcgccccaaggugcgggaccaggagggccgcaucaacuacuacuggacgcuccuggagcccggggacaccaucaucuucgaggccaacggcaaccugaucgccccgcgguacgccuucgcgcucucccgcggguucggcagcggcaucaucaacuccaacgcccccauggacaagugcgacgccaagugccagacgccccagggggccaucaacagcucccugcccuuccagaacgugcacccggucaccaucggcgagugccccaaguacgugcggucggccaagcugcgcauggugaccgggcuccggaacauccccuccauccagagccgcggccuguucggggcgaucgccggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacgcaguucaccgcggucgggaaggaguucaacaagcuggagcggcgcauggagaaccucaacaagaagguggacgacggcuucaucgacaucuggaccuacaacgccgagcugcugguccuccuggagaacgagcggacccuggacuuccacgacucgaacgugaagaaccucuacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcugaaccgcgagaagaucgacggcgugaagcucgaguccaugggcguguaccagauccuggccaucuacucgaccgucgccagcucccuggugcuccuggugagccugggggcgaucuccuucuggaugugcagcaacggcucccuccagugccggaucugcaucuga

SEQ ID NO: 2534 - RNA, 1698 nt, Artificial Sequence; identical to SEQ ID NO: 2300
  derived and/or modified CDS sequence (AUadapt) from InfluenzaA__ACD56113__HA

SEQ ID NO: 2535 - RNA, 1698 nt, Artificial Sequence; identical to SEQ ID NO: 2159
  derived and/or modified CDS sequence (AUadapt) from InfluenzaA__ACD56124__HA

SEQ ID NO: 2536 - RNA, 1701 nt, Artificial Sequence; identical to SEQ ID NO: 2232
  derived and/or modified CDS sequence (AUadapt) from InfluenzaA__ACD56258__HA

SEQ ID NO: 2537 - RNA, 1701 nt, Artificial Sequence; identical to SEQ ID NO: 1974
  derived and/or modified CDS sequence (AUadapt) from InfluenzaA__ACD56269__HA

SEQ ID NO: 2538 - RNA, 1698 nt, Artificial Sequence
  derived and/or modified CDS sequence (AUadapt) from InfluenzaA__ACD56280__HA
augaaggugaagcugcucauccugcugugcaccuucaccgccacguacgccgacaccaucugcaucggcuaccacgcgaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccggcaacggcacgugcuaccccggguacuucgccgacuacgaggagcugcgcgagcagcucuccagcguguccucguucgagcgguucgagaucuucccgaaggaguccagcuggcccaaccacaccgugaccggcgucuccgccagcugcucccacaacggcaagagcuccuucuaccgcaaccugcuguggcucaccgggaagaacgggcuguaccccaaccugagcaaguccuacgccaacaacaaggagaaggaggugcucgugcuguggggcguccaccacccgcccaacaucggcgaccagcgggcccuguaccacacggagaacgccuacgugucgguggucagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgcgguucgccuucgcccucucccgcggcuucggcagcgggaucaucacguccaacgcccccauggacgagugcgaggcgaagugccagacgccccagggcgccaucaacagcucccugcccuuccagaacgugcacccggucaccaucggggagugccccaaguacgugcggucgaccaagcugcgcauggugaccggccuccggaacauccccuccauccagagccgcgggcuguucggcgccaucgccggcuucaucgagggcggguggaccgggauggucgacggcugguacggguaccaccaccagaacgagcagggcuccggcuacgccgcggaccagaaguccacccagaacgccaucaacgggaucaccaacaaggugaacagcgugaucgagaagaugaacacgcaguucaccgccgucggcaaggaguucaacaagcuggagcggcgcauggagaaccucaacaagaagguggacgacggguuccuggacaucuggaccuacaacgccgagcugcucguccugcuggagaacgagcggacccucgacuuccacgacagcaacgugaagaaccuguacgagaaggugaagucccagcugaagaacaacgccaaggagaucggcaacgggugcuucgaguucuaccacaagugcaacgacgagugcauggagagcgucaagaacggcacguacgacuaccccaaguacuccgaggagucgaagcucaaccgcgagaagaucgacggcgugaagcuggaguccauggggguguaccagauccuggcgaucuacagcaccgucgccagcucccucgugcugcuggugagccucggcgccaucuccuucuggaugugcagcaacgggucccugcagugccggaucugcaucuga

SEQ ID NO: 2539 - RNA, 1689 nt, Artificial Sequence
  derived and/or modified CDS sequence (AUadapt) from InfluenzaA__ACD56324__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaagaacauccucgagaagacccacaacggccgccugugcaagcugaacgggaucccgccccucgagcugggcgacugcuccaucgccggguggcugcucggcaaccccgagugcgaccggcugcugcgcguccccgaguggucguacaucauggagaaggagaacccccggaacggccucugcuacccgggguccuucaacgacuacgaggagcugaagcaccuccugucguccgugaagcacuucgagaaggugcgcauccugcccaaggaccgguggacgcagcacaccaccaccggcagcucccgcgccugcgccgucucggggaaccccuccuucuuccggaacaugguguggcugacgaagaaggagucgaacuaccccguggcgaagggcuccuacaacaacaccagcggggagcagaugcucaucaucuggggcguccaccacccgaucgacgagaccgagcagcgcacccuguaccagaacgugggcacguacguguccgucgggaccucgacccugaacaagcgguccacccccgacaucgccacgcgccccaaggugaacggccucgggucgcggauggaguucuccuggacccugcuggacaugugggacaccaucaacuucgagagcaccggcaaccucaucgcccccgaguacggcuucaagaucuccaagcgcgggucgucgggcaucaugaagacggagcggacccuggagaacugcgagaccaagugccagaccccgcugggggccaucaacacgacccuccccuuccacaacgugcacccccugaccaucggcgagugccccaaguacgucaaguccgagaagcuggugcucgcgaccgggcugcgcaacgugccgcagaucgagccccggggccuguucggcgccaucgccggguucaucgagggcggguggcagggcauggucgacgggugguacggcuaccaccacucgaacgaccagggcuccggguacgccgccgacaaggagagcacgcagaaggcguucgacggcaucaccaacaaggugaacuccgugaucgagaagaugaacacccaguucgaggccgucgggaaggaguucucgaaccucgagcgccggcuggagaaccugaacaagaagauggaggacggcuuccucgacguguggaccuacaacgccgagcugcuggugcucauggagaacgagcgcacgcuggacuuccacgacuccaacgucaagaaccuguacgacaaggugcggaugcagcuccgcgacaacgucaaggagcuggggaacggcugcuucgaguucuaccacaagugcgacgacgagugcaugaacucggugaagaacggcaccuacgacuaccccaaguacgaggaggaguccaagcugaaccgcaacgagaucaagggggugaagcucagcuccaugggcgucuaccagauccuggccaucuacgccaccguggcggggucgcugucccucgccaucaugauggccggcaucucguucuggaugugcuccaacggcagccugcagugccggaucugcaucuga

SEQ ID NO: 2540 - RNA, 1689 nt, Artificial Sequence
  derived and/or modified CDS sequence (AUadapt) from InfluenzaA__ACD85187__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcucguucaacgacuacgaggagcugaagcaccuccuguccagcgugaagcacuucgagaaggugaagauccugcccaaggaccgguggacgcagcacaccaccaccgggggcuccaaggccugcgccgucucggggaagcccuccuucuuccgcaacaugguguggcugacgaagaagggccccaacuacccgguggcgaaggggucguacaacaacaccuccggcgagcagaugcucaucaucuggggcguccaccaccccaaggacgaggccgagcagcgggcccuguaccaggagguggggaccuacgugucggccuccaccagcacgcugaacaagcgcuccacccccgagaucgcggcccggcccgaggucaacggccucgggucgcgcauggaguucuccuggacccugcuggacgugugggacaccaucaacuucgagucgacgggcaaccucguggccccggaguacggcuucaagaucuccaagcgggggucgagcggcaucaugaagaccgaggggacccugggcaacugcgagaccaagugccagacgccccugggggccaucaacaccacccuccccuuccacaacguccacccccugaccaucggcgagugcccgaaguacgugaaguccgagaagcuggugcucgccacgggccugcgcaacgucccccagaucgagucgcgggggcuguucggcgcgaucgccggguucaucgagggcggguggcagggcaugguggacggcugguacggguaccaccacuccaacgaccagggcucgggguacgccgccgacaaggaguccacccagaaggccuucgacggcaucaccaacaaggugaacucggucaucgagaagaugaacacccaguucgaggcgguggggaaggaguucaacaaccucgagaagcgccuggagaaccugaacaagaagauggaggacggcuuccucgacguguggacguacaacgccgagcugcugguccucauggagaacgagcggacccuggacuuccacgacuccaacgugaagaaccuguacgacaagguccgcaugcagcuccgggacaacgugaaggagcugggcaacgggugcuucgaguucuaccacaagugcgacgacgagugcaugaacagcgugaagaacggcaccuacgacuaccccaaguacgaggaggaguccaagcugaaccgcaacgagaucaagggggucaagcucucguccaugggcguguaccagauccuggccaucuacgccaccguggccggcucgcugucccucgcgaucaugauggccgggaucucguucuggaugugcuccaacggcagccugcagugccggaucugcaucuga

SEQ ID NO: 2541 - RNA, 1689 nt, Artificial Sequence
  derived and/or modified CDS sequence (AUadapt) from InfluenzaA__ACD85198__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcucguucaacgacuacgaggagcugaagcaccuccuguccagcgugaagcacuucgagaaggugaagauccugcccaaggacggguggacgcagcacaccaccaccggcggguccaaggccugcgccgucucgggcaagcccuccuucuuccggaacaugguguggcugacgaagaaggggcccaacuacccgguggcgaagcgcucguacaacaacaccuccggcgagcagaugcucaucaucuggggcguccaccaccccaccgacgaggccgagcagcgggcccuguaccaggagguggggaccuacgugagcgccuccacgucgacccugaacaagcgcuccacccccgagaucgcggcccggcccgaggucaacggccuccgcucgcggauggaguucuccuggacccugcuggacgugugggacacgaucaacuucgagagcaccgggaaccucguggccccggaguacggcuucaagaucuccaagcgcggcucgucggggaucaugaagaccgagggcacccuggggaacugcgagacgaagugccagacgccccugggcgccaucaacaccacccuccccuuccacaacguccacccccugaccaucggggagugcccgaaguacgugaaguccgagaagcuggugcucgccaccggccugcggaacgucccccagaucgagucgcgcggccuguucggggcgaucgccggcuucaucgagggcggguggcaggggaugguggacggcugguacggcuaccaccacuccaacgaccaggggagcggcuacgccgccgacaaggaguccacccagaaggccuucgaccggaucaccaacaaggugaacucggucaucgagaagaugaacacgcaguucgaggcgguggggaaggaguucuccaaccucgagaagcgccuggagaaccugaacaagaagauggaggacggcuuccucgacguguggaccuacaacgccgagcugcugguccucauggagaacgagcggacccugggguuccacgacucgaacgugaagaaccuguacgacaagguccgcaugcagcuccgggacaacgugaaggagcugggcaacggcugcuucgaguucuaccacaagugcgacgacgagugcaugaacuccgugaagaacgggaccuacgacuaccccaaguacgaggaggagagcaagcugaagcgcaacgagaucaagggcgucaagcucuccucgauggggguguaccagauccuggccaucuacgccacgguggccggcucccugucgcucgcgaucaugauggccggcaucuccuucuggaugugcagcaacgggucccugcagugccggaucugcaucuga

SEQ ID NO: 2542 - RNA, 1689 nt, Artificial Sequence
  derived and/or modified CDS sequence (AUadapt) from InfluenzaA__ACD85209__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccucggugaagcacuucgagaaggugaagauccugcccaaggaccgcuggacgcagcacaccaccaccggcgggucccgggccugcgccgucagcggcaaccccuccuucuuccgcaacaugguguggcugacgcagaaggggucgaacuaccccguggcgaagggcuccuacaacaacaccucgggcgagcagaugcucaucaucuggggcguccaccacccgaacgacgagaccgagcagcggacccuguaccagaacguggggacguacguguccgucgggaccucgacccugaacaagcgcuccacccccgacaucgccacgcggcccaaggugaacggccagggcgggcgcauggaguucucguggacccuccuggacaugugggacaccaucaacuucgaguccaccggcaaccugaucgcccccgaguacggguucaagaucagcaagcggggcuccucggggaucaugaagacggagggcacccucgagaacugcgagaccaagugccagaccccgcugggcgccaucaacacgacccugcccuuccacaacgugcacccccucaccaucggggagugccccaaguacgucaagucggagaagcuggugcuggcgaccggccuccgcaacgugccgcagaucgagucccgggggcuguucggcgccaucgccggguucaucgagggcggcuggcaggggauggucgacggcugguacggguaccaccacucgaacgaccagggcuccggguacgccgccgacaaggagucgacgcagaaggcguucgacggcaucaccaacaaggugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacucggugaagaacggcaccuacgacuaccccaaguacgaggaggaguccaagcugaaccggaacgagaucaagggcgugaagcugucguccaugggggucuaccagauccucgccaucuacgccaccguggcgggcucgcugucccuggccaucaugauggccgggaucucguucuggaugugcuccaacggcagccuccagugccgcaucugcaucuga

SEQ ID NO: 2543 - RNA, 1689 nt, Artificial Sequence
  derived and/or modified CDS sequence (AUadapt) from InfluenzaA__ACD85220__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaaccccaaguacucccucugcuacccgggcucguucaacgacuacgaggagcugaagcaccuccuguccagcgugaagcacuucgagaaggugaagauccugcccaaggaccgcuggacgcagcacaccaccaccgggggcuccaaggccugcgccgucucgggggagcccuccuucuuccggaacaugguguggcugacgaagaagggccccaacuacccgguggcgaaggggucguacaacaacaccuccggcgagcagaugcucaucaucuggggcguccaccaccccaaggacgaggccgagcagcgcgcccuguaccagaacguggggaccuacgugucggccuccaccagcacgcugaacaagcgguccacccccgagaucgcggcccgccccgaggucaacggccucgggucgcggauggaguucuccuggacccugcuggacgugugggacaccaucaacuucgagucgacgggcaaccucguggccccggaguacggcuucaagaucuccaagcgcgggucgagcggcaucaugaagaccgaggggacccugggcaacugcgagaccaagugccagacgccccugggggccaucaacaccacccuccccuuccacaacguccacccccugaccaucggcgagugcccgaaguacgugaaguccgagaagcuggugcucgccacgggccugcggaacgucccccagaucgagucgcgcgggcuguucggcgcgaucgccggguucaucgagggcggguggcagggcaugguggacggcugguacggguaccaccacuccaacgaccagggcucgggguacgccgccgacaaggaguccacccagaaggccuucgacggcaucaccaacaaggugaacucggucaucgagaagaugaacacccaguucgaggcgguggggaaggaguucaacaaccucgagaagcggcuggagaaccugaacaagaagauggaggacggcuuccucgacguguggacguacaacgccgagcugcugguccucauggagaacgagcgcacccuggacuuccacgacuccaacgugaagaaccuguacgacaagguccggaugcagcuccgcgacaacgugaaggagcugggcaacgggugcuucgaguucuaccacaagugcgacgacgagugcaugaacagcgugaagaacggcaccuacgacuaccccaaguacgagaaggaguccaagcugaaccggaacgagaucaagggggucaagcucucguccaugggcguguaccagauccuggccaucuacgccaccguggccggcucgcugucccucgcgaucaugauggccgggaucucguucuggaugugcuccaacggcagccugcagugccgcaucugcaucuga

SEQ ID NO: 2544 - RNA, 1689 nt, Artificial Sequence
  derived and/or modified CDS sequence (AUadapt) from InfluenzaA__ACD85242__HA
auggccaucaucuaccugauccuccuguucgccaccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcucgcugaacgacuacgaggagcugaagcaccuccuguccagcgugaagcacuucgagaaggugcggauccugcccaaggaccgcuggacgcagcacaccaccaccgggggcuccaaggccugcgccgucucggggaagcccuccuucuuccggaacaugguguggcucacgaagaagggccccaacuacccgguggcgaaggggucguacaacaacaccuccggcgagcagaugcugaucaucuggggcguccaccaccccaaggacgaggccgagcagcgcgcccuguaccaggagguggggaccuacgugucggccuccaccagcacgcucaacaagcgguccauccccgagaucgcggcccgccccgaggucaacggccuggggucgcggauggaguucuccuggacccugcucgacgugugggacaccaucaacuucgagucgaccggcaaccugguggccccggaguacggcuucaagaucuccaagcgcgggucgagcggcaucaugaagacggaggggacccugggcaacugcgagaccaagugccagacgccccucggggccaucaacaccacccugcccuuccacaacguccacccccugaccaucggcgagugcccgaaguacgugaaguccgagaagcucgugcuggccaccggccugcggaacgucccccagaucgagucgcgcggccucuucggggcgaucgccggguucaucgagggcggguggcagggcaugguggacggcugguacggguaccaccacuccaacgaccagggcucgggguacgccgccgacaaggaguccacgcagaaggccuucgacggcaucaccaacaaggugaacucgaugaucgagaagaugaacacccaguucgaggcggucgggaaggaguucaacaaccuggagaagcggcuggagaaccucgacaagaagauggaggacggcuuccuggacguguggaccuacaacgccgagcugcucgugcugauggagaacgagcgcacgcuggacuuccacgacuccaacgucaagaaccucuacgagaaggugcggaugcagcugcgcgacaacgucaaggagcugggcaacgggugcuucgaguucuaccacaagugcgacaacgagugcaugaacagcgugaagaacggcaccuacgacuaccccaaguacgaggaggaguccaagcucaagcggaacgagaucaagggggugaagcugucguccaugggcgucuaccagauccuggccaucuacgccaccguggccggcucgcucucccuggcgaucaugguggccgggaucucguucuggaugugcuccaacggcagccugcagugccgcaucugcaucuga

SEQ ID NO: 2545 - RNA, 1689 nt, Artificial Sequence
  derived and/or modified CDS sequence (AUadapt) from InfluenzaA__ACD85253__HA
auggccaucaucuaccugauccuccuguucgccaccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacaaccucugcuacccgggcucccugaacgaguacgaggagcugaagcaccuccugucguccgugaagcacuucgagaaggugcggauccugcccaaggaccgcuggacgcagcacaccaccaccgggggcagcaaggccugcgccgucuccggggagcccucguucuuccggaacaugguguggcucacgaagaagggccccaacuacccgguggcgaagggguccuacaacaacaccucgggcgagcagaugcugaucaucuggggcguccaccaccccaacgacgaggccgagcagcgcgcccuguaccagaagguggggaccuacguguccgccagcaccuccacgcucaacaagcggucgauccccgagaucgcggcccgccccaaggucaacggccuggggucccggauggaguucuucuggacccugcucgacgugugggacaccaucaacuucgagucgaccggcaaccugguggucccggaguacggcuucaagaucuccaagcgcgggagcuccggcaucaugaagacggaggggacccugggcaacugcgagaccaagugccagacgccccucggggccaucaacaccacccugcccuuccacaacgugcacccccugaccaucggcgagugcccgaaguacgucaagucggagaagcucgugcuggccaccggccugcggaacgugccccagaucgagucgcgcggccucuucggggccaucgcgggguucaucgagggcggguggcagggcaugguggacggcugguacggguaccaccacuccaacgaccagggcagcggguacgccgccgacaaggaguccacgcagaaggccuucgacggcaucaccaacaaggucaacucggugaucgagaagaugaacacccaguucgagaccguggggaaggaguucaacaaccuggagaagcggcuggagaaccucaacaagaagauggaggacggcuuccuggacgucuggacguacaacgccgagcugcucgugcugauggagaacgagcgcacccuggacuuccacgacuccaacgucaagaaccucuacgagaaggugcggaugcagcugcgcgacaacgugaaggagcugggcaacgggugcuucgaguucuaccacaagugcgacgacgagugcaugaacucggucaagaacggcaccuacgacuaccccaaguacgaggaggaguccaagcucaagcggaacgagaucaagggggugaagcugagcuccaugggcguguaccagauccuggcgaucuacgccaccgucgccggcucgcucucccuggccaucaugguggccgggaucucguucuggaugugcuccaacggcagccugcagugccgcaucugcaucuga

SEQ ID NO: 2546 - RNA, 1701 nt, Artificial Sequence
  derived and/or modified CDS sequence (AUadapt) from InfluenzaA__ACD85440__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggaccucgggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 2547 - RNA, 1701 nt, Artificial Sequence; identical to SEQ ID NO: 2546
  derived and/or modified CDS sequence (AUadapt) from InfluenzaA__ACD85451__HA

SEQ ID NO: 2548 - RNA, 1701 nt, Artificial Sequence; identical to SEQ ID NO: 2546
  derived and/or modified CDS sequence (AUadapt) from InfluenzaA__ACD85462__HA

SEQ ID NO: 2549 - RNA, 1701 nt, Artificial Sequence; identical to SEQ ID NO: 2173
  derived and/or modified CDS sequence (AUadapt) from InfluenzaA__ACD85473__HA

SEQ ID NO: 2550 - RNA, 1701 nt, Artificial Sequence
  derived and/or modified CDS sequence (AUadapt) from InfluenzaA__ACD85484__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2551 - RNA, 1701 nt, Artificial Sequence; identical to SEQ ID NO: 2173
  derived and/or modified CDS sequence (AUadapt) from InfluenzaA__ACD85495__HA

SEQ ID NO: 2552 - RNA, 1701 nt, Artificial Sequence
  derived and/or modified CDS sequence (AUadapt) from InfluenzaA__ACD85528__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgucagccugcggucccucguggcgucguccggcacgcuggaguucaacaacgagagcuucaacuggaccggggugacccagaacggcaccuccucggccugcauccgccgguccaacaagagcuucuucucccgccugaacuggcucacgcaccugaaguucaaguaccccgcccugaacgucaccaugcccaacaacgagaacuucgacaagcucuacaucuggggcgugcaccaccccgggaccgacaacgaccagaucuuccuguacgcccaggcgucggggcggaucaccguguccacgaagcgcagccagcagaccgucaucccgaacaucggcucgcggccccgcgugcggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgcgaucgccggguucaucgagaacggcugggagggcauggucgacgggugguacggcuuccgccaccagaacagcgaggggaucggccaggccgccgaccugaaguccacccaggccgcgaucgaccagaucaacgggaagcugaaccggcucaucggcaagaccaacgagaaguuccaccagaucgagaaggaguucucggagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggaccucgggaacggcugcuucaagaucuaccacaagugcgacaacgccugcaucggguccauccgcaacggcaccuacgaccacgacguguaccgcgacgaggcgcugaacaaccgguuccagaucaaggggguggagcugaaguccggcuacaaggacuggauccucuggaucuccuucgccaucagcugcuuccugcugugcgucgcccuccugggcuucaucaugugggccugccagaaggggaacauccgcugcaacaucugcaucuga

SEQ ID NO: 2553 - RNA, 1701 nt, Artificial Sequence
  derived and/or modified CDS sequence (AUadapt) from InfluenzaA__ACD85539__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccggacgaacaacuccuucuucucgcgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucacggugucgaccaagcgcucccagcagaccgugaucccgaacaucggcagccggccccgcguccggaacauccccucgcgcaucuccaucuacuggaccaucgugaagcccggcgacauccugcucaucaacagcacggggaaccugaucgccccgcggggcuacuucaagauccgcuccgggaaguccuccaucaugcggucggacgcccccaucggcaagugcaacuccgagugcaucacccccaacggcagcauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcacguacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 2554 - RNA, 1701 nt, Artificial Sequence
  derived and/or modified CDS sequence (AUadapt) from InfluenzaA__ACD85550__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggaccucgggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaugagcugcuuccugcugugcguggcccuccugggcuucaucaugugggccugccagaaggggaacauccgcugcaacaucugcaucuga

SEQ ID NO: 2555 - RNA, 1701 nt, Artificial Sequence; identical to SEQ ID NO: 2173
  derived and/or modified CDS sequence (AUadapt) from InfluenzaA__ACD85561__HA

SEQ ID NO: 2556 - RNA, 1701 nt, Artificial Sequence
  derived and/or modified CDS sequence (AUadapt) from InfluenzaA__ACD85572__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaccggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2557 - RNA, 1701 nt, Artificial Sequence; identical to SEQ ID NO: 2553
  derived and/or modified CDS sequence (AUadapt) from InfluenzaA__ACD85583__HA

SEQ ID NO: 2558 - RNA, 1701 nt, Artificial Sequence
  derived and/or modified CDS sequence (AUadapt) from InfluenzaA__ACD93579__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacacgugcaucggguccauccgcaacggcaccuacgaccacgacgucuaccgcgacgaggcgcucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2559 - RNA, 1701 nt, Artificial Sequence; identical to SEQ ID NO: 875
  derived and/or modified CDS sequence (AUadapt) from InfluenzaA__ACF09402__HA

SEQ ID NO: 2560 - RNA, 1701 nt, Artificial Sequence
  derived and/or modified CDS sequence (AUadapt) from InfluenzaA__ACF22159__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccgggggcaucugcgacagcccccaccagauccucgacggggagaacugcacccugaucgacgcccugcucggcgacccccagugcgacggcuuccagaacaagaagugggaccuguucguggagcgcuccaaggccuacucgaacugcuaccccuacgacgugccggacuacgcgucccugcggucgcucgucgccuccagcgggacgcuggaguucaacaacgaguccuucaacuggaccggcgugacccagaacgggaccucguccgccugcaagcgccggagcaacaaguccuucuucucgcgccugaacuggcucacgcaccugaaguacaaguaccccgcccugaacgugaccaugcccaacaacgagaaguucgacaagcucuacaucuggggcguccaccaccccgggaccgacuccgaccagaucucgcuguacgcgcaggccuccggccggaucaccgugagcacgaagcgcucgcagcagaccgugaucccgaacaucggcuuccggccccgcguccgggacguguccucgcgcaucuccaucuacuggaccaucgugaagcccggggacauccugcucaucaacagcaccggcaaccugaucgcgccccggggguacuucaagauccgcuccggcaagucguccaucaugcggagcgacgccccgaucggcaagugcaacuccgagugcaucacgcccaacgggucgauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagucgacccaggcggccaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagucgauccgcaacggcacguacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 2561 - RNA, 1701 nt, Artificial Sequence
  derived and/or modified CDS sequence (AUadapt) from InfluenzaA__ACF22188__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucuggagccgccccugggugcggggccuguccucgcgcaucuccaucuacuggaccaucgucaagcccggcgacgugcucgugaucaacagcaacgggaaccugaucgcgccgcggggcuacuucaagaugcgcaccgggaaguccucgaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacucggagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacucggagaugaacaagcuguucgagaagacgcggcgccagcugcgggagaacgccgaggacaugggcaacgggugcuucaagaucuaccacaagugcgacaacgccugcaucgaguccauccgcaacggcaacuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 2562 - RNA, 1701 nt, Artificial Sequence; identical to SEQ ID NO: 2561
  derived and/or modified CDS sequence (AUadapt) from InfluenzaA__ACF22199__HA

SEQ ID NO: 2563 - RNA, 1701 nt, Artificial Sequence; identical to SEQ ID NO: 65
  derived and/or modified CDS sequence (AUadapt) from InfluenzaA__ACF22210__HA

SEQ ID NO: 2564 - RNA, 1701 nt, Artificial Sequence; identical to SEQ ID NO: 65
  derived and/or modified CDS sequence (AUadapt) from InfluenzaA__ACF22221__HA

SEQ ID NO: 2565 - RNA, 1701 nt, Artificial Sequence; identical to SEQ ID NO: 65
  derived and/or modified CDS sequence (AUadapt) from InfluenzaA__ACF22232__HA

SEQ ID NO: 2566 - RNA, 1701 nt, Artificial Sequence; identical to SEQ ID NO: 65
  derived and/or modified CDS sequence (AUadapt) from InfluenzaA__ACF22243__HA

SEQ ID NO: 2567 - RNA, 1701 nt, Artificial Sequence; identical to SEQ ID NO: 65
  derived and/or modified CDS sequence (AUadapt) from InfluenzaA__ACF22254__HA

SEQ ID NO: 2568 - RNA, 1701 nt, Artificial Sequence; identical to SEQ ID NO: 65
  derived and/or modified CDS sequence (AUadapt) from InfluenzaA__ACF22265__HA

SEQ ID NO: 2569 - RNA, 1701 nt, Artificial Sequence; identical to SEQ ID NO: 65
  derived and/or modified CDS sequence (AUadapt) from InfluenzaA__ACF22276__HA

SEQ ID NO: 2570 - RNA, 1701 nt, Artificial Sequence; identical to SEQ ID NO: 65
  derived and/or modified CDS sequence (AUadapt) from InfluenzaA__ACF22287__HA

SEQ ID NO: 2571 - RNA, 1701 nt, Artificial Sequence; identical to SEQ ID NO: 65
  derived and/or modified CDS sequence (AUadapt) from InfluenzaA__ACF22298__HA

SEQ ID NO: 2572 - RNA, 1701 nt, Artificial Sequence; identical to SEQ ID NO: 65
  derived and/or modified CDS sequence (AUadapt) from InfluenzaA__ACF22320__HA

SEQ ID NO: 2573 - RNA, 1701 nt, Artificial Sequence; identical to SEQ ID NO: 65
  derived and/or modified CDS sequence (AUadapt) from InfluenzaA__ACF22342__HA

SEQ ID NO: 2574 - RNA, 1701 nt, Artificial Sequence; identical to SEQ ID NO: 141
  derived and/or modified CDS sequence (AUadapt) from InfluenzaA__ACF22364__HA

SEQ ID NO: 2575 - RNA, 1701 nt, Artificial Sequence; identical to SEQ ID NO: 2553
  derived and/or modified CDS sequence (AUadapt) from InfluenzaA__ACF22408__HA

SEQ ID NO: 2576 - RNA, 1701 nt, Artificial Sequence; identical to SEQ ID NO: 2173
  derived and/or modified CDS sequence (AUadapt) from InfluenzaA__ACF41669__HA

SEQ ID NO: 2577 - RNA, 1698 nt, Artificial Sequence; identical to SEQ ID NO: 2159
  derived and/or modified CDS sequence (AUadapt) from InfluenzaA__ACF41680__HA

SEQ ID NO: 2578 - RNA, 1689 nt, Artificial Sequence
  derived and/or modified CDS sequence (AUadapt) from InfluenzaA__ACF41691__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagcuucaacgacuacgaggagcugaagcaccuccuguccucggugaagcacuucgagaaggugaagauccugcccaaggacggguggacgcagcacgagaccgacggcggguccaaggccugcgccgucucgggcaagcccuccuucuuccggaacaugguguggcugaccaagaaggggcccaacuacccgguggcgaagcgcagcuacaacaacaccuccggcgagcagaugcucaucaucuggggcguccaccaccccaacgacgaggccgagcagcgggcccuguaccaggagguggggacguacgugucggccuccaccagcacccugaacaagcgcuccacccccgagaucgcggcccggcccaaggucucgggccucgggucccgcauggaguucucguggacgcugcuggacgugugggacaccaucuccuucgagagcaccggcaaccucguggccccggaguacggcuucaagaucucgaagcggggguccucgggcaucaugaagaccgaggggacgcugggcaacugcgagaccaagugccagacgccccugggggccaucaacaccacccuccccuuccacaacguccacccccugaccaucggcgagugcccgaaguacgugaaguccgagaagcuggugcucgccaccggccugcgcaacgucccccagaucgagagccgggggcuguucggcgcgaucgccggguucaucgagggcggguggcagggcaugguggacggcugguacggguaccaccacuccaacgaccagggcucgggguacgccgccgacaaggaguccacccagaaggccuucgaccgcaucacgaacaaggugaacagcgucaucgagaagaugaacacccaguucgaggcggugggcaaggaguucuccaaccucgagaagcggcuggagaaccugaacaagaagauggaggacggguuccucgacguguggaccuacaacgccgagcugcugguccucauggagaacgagcgcacccuggacuuccacgacucgaacgugaagaaccuguacgacaagguccggaugcagcuccgcgacaacgugaaggagcugggcaacggcugcuucgaguucuaccacaagugcgacgacgagugcaugaacuccgugaagaacgggacguacgacuaccccaaguacgaggaggagucgaagcugaagcggaacgagaucaagggcgucgagcucuccagcauggggguguaccagauccuggccaucuacgccaccguggccggcucccugucgcucgcgaucaugaucgccggcaucuccuucuggaugugcagcaacgggucccugcagugccgcaucugcaucuga

SEQ ID NO: 2579 - RNA, 1701 nt, Artificial Sequence; identical to SEQ ID NO: 2561
  derived and/or modified CDS sequence (AUadapt) from InfluenzaA__ACF41735__HA

SEQ ID NO: 2580 - RNA, 1701 nt, Artificial Sequence
  derived and/or modified CDS sequence (AUadapt) from InfluenzaA__ACF41790__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgaggacuucaccuggacgggggugacccagaacggcggguccaacgccugcaagcggggccccgggagcggcuucuucucccgccucaacuggcugaccaagucgggcuccaccuaccccgugcuggacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucgggucgcgccccugggugcggggccuguccagccgcaucuccaucuacuggaccaucgucaagcccggcgacgugcucgugaucaacucgaacgggaaccugaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucucggagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagucgggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 2581 - RNA, 1701 nt, Artificial Sequence
  derived and/or modified CDS sequence (AUadapt) from InfluenzaA__ACF41823__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccgccagaccaucauccccaacaucggcucgcggcccugggugcgcggccuguccagccggaucuccaucuacuggaccaucgucaagcccggggacgugcucgugaucaacucgaacggcaaccugaucgcgccgcgcggguacuucaagaugcggaccggcaaguccagcaucaugcgcuccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcggaacgugcccgagaagcagacccgcgggcuguucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcucaaccgcgucaucgagaagacgaacgagaaguuccaccagaucgagaaggaguucucggagguggagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuaccacaagugcgacaacgccugcaucgaguccauccgcaacggcaccuacgaccacaacguguaccgggacgaggcccucaacaaccgcuuccagaucaagggggucgagcucaagucgggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 2582 - RNA, 1698 nt, Artificial Sequence
  derived and/or modified CDS sequence (AUadapt) from InfluenzaA__ACF41834__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaaccugaagaacucguacgucaacaagaagggcaaggaggugcucgugcugugggggauccaccacccguccaacagcaaggagcagcagaaccuguaccagaacgagaacgcguacgucuccguggugacgucgaacuacaaccggcgcuucacccccgagaucgccgagcggcccaagguccgcgaccaggccggccggaugaacuacuacuggacccuccugaagcccggcgacaccaucaucuucgaggccaacgggaaccugaucgccccgauguacgcguucgcccucagccgcggcuucggguccggcaucaucacgagcaacgccuccaugcacgagugcaacaccaagugccagacgccccugggcgccaucaacucgucccugcccuaccagaacauccaccccgugaccaucggggagugcccgaaguacgugcggagcgccaagcuccgcauggucaccggccugcggaacauccccuccauccagucgcgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagucgcagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagucgaugggcaucuaccagauccucgccaucuacuccaccgucgccagcucccuggugcugcucgugucgcugggcgcgaucagcuucuggaugugcuccaacgggagccugcagugccggaucugcaucuga

SEQ ID NO: 2583 - RNA, 1701 nt, Artificial Sequence
  derived and/or modified CDS sequence (AUadapt) from InfluenzaA__ACF41856__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccucguccggcacgcuggaguucaucaacgaggacuucaacuggaccgggguggcccaggacggcgggagcuacgccugcaagcgcggcuccgugaacucguucuucucccggcucaacuggcugcacaagagcgaguacaaguaccccgcgcugaacgucaccaugcccaacaacgggaaguucgacaagcucuacaucuggggcgugcaccaccccuccaccgaccgcgaccagacgucgcuguacgugcgggccuccggccgcgucaccgugucgaccaagcggagccagcagaccgugacgccgaacaucgggucccgccccuggguccggggccagucgucccgcaucagcaucuacuggaccaucgugaagcccggggacauccugcucaucaacuccaccggcaaccugaucgcgccccggggcuacuucaagauccgcaacggcaagucguccaucaugcggucggacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacucggagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 2584 - RNA, 1698 nt, Artificial Sequence
  derived and/or modified CDS sequence (AUadapt) from InfluenzaA__ACF41867__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugucguccgugagcuccuucgagcgguucgagaucuucccgaaggagagcuccuggcccaaccacaccgugaccggggucaccgccagcugcucccacaacggcaagucguccuucuaccgcaaccuccuguggcugacggagaagaacgggcucuaccccaaccugagcaacuccuacgugaacaacaaggagaaggaggugcugguccucuggggcgugcaccaccccagcaacauccgggaccagcgcgccaucuaccacaccgagaacgccuacgugagcgucguguccagccacuacucccggcgcuucaccccggagaucgccaagcggcccaaggugcgcgggcaggagggccggaucaacuacuacuggacccugcuggagcccggcgacacgaucaucuucgaggcgaacgggaaccucaucgcccccugguacgccuucgcccugucgcgcggcuucggguccggcaucaucaccagcaacgccccgaugaacgagugcgacgcgaagugccagacgccccagggcgccaucaacuccagccugcccuuccagaacguccaccccgugaccaucggggagugcccgaaguacgugcgguccaccaagcuccgcauggucaccggccugcggaacauccccagcauccagucccgcgggcuguucggcgccaucgccggguucaucgagggcggcuggaccgggaugauggacggcugguacggguaccaccaccagaacgagcagggcucgggguacgccgcggaccagaaguccacccagaacgccaucaacggcaucacgaacaaggugaacagcgugaucgagaagaugaacacccaguucaccgccgucggcaaggaguucaacaagcucgagcggcgcauggagaaccugaacaagaagguggacgacggguuccuggacaucuggaccuacaacgccgagcuccugguccugcucgagaacgagcggacgcuggacuuccacgacuccaacgugaagaaccuguacgagaaggucaagagccagcucaagaacaacgccaaggagaucggcaacgggugcuucgaguucuaccacaagugcaacaacgagugcauggaguccgugaagaacggcaccuacgacuaccccaaguacagcgaggaguccaagcugaaccgcgagaagaucgacggggugaagcuggagucgaugggcguguaccagauccucgcgaucuacagcaccgucgccuccagccuggugcugcucgugucccugggcgccaucagcuucuggaugugcuccaacgggagccugcagugccggaucugcaucuga

SEQ ID NO: 2585 - RNA, 1698 nt, Artificial Sequence; identical to SEQ ID NO: 2360
  derived and/or modified CDS sequence (AUadapt) from InfluenzaA__ACF41878__HA

SEQ ID NO: 2586 - RNA, 1701 nt, Artificial Sequence
  derived and/or modified CDS sequence (AUadapt) from InfluenzaA__ACF41922__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccgaagugcgagagccuguucuccaaggagagcugguccuacaucgccgagacccccaaccccgagaacgggaccugcuaccccggcuacuucgccgacuacgaggagcuccgggagcagcugucguccgucagcuccuucgagcgcuucgagaucuucccgaaggagagcuccuggcccaaccacacggugaccaagggggugaccgccagcugcucccacaacggcaagucguccuucuaccggaaccugcucuggcugaccgagaagaacgggcuguaccccaaccucagcaaguccuacgucaacaacaaggagaaggaggugcuggugcuguggggcguccaccaccccagcaacauccgcgaccagcgggccaucuaccacacggagaacgcguacgugagcguggucuccagccacuacucccgccgguucaccccggagaucgccaagcgccccaaggugcgggaccaggaggggcgcaucaacuacuacuggacccuccuggagcccggcgacaccaucaucuucgaggccaacggcaaccugaucgcccccugguacgccuucgcgcucucgcggggguucggcuccgggaucaucacgagcaacgccuccauggacgagugcgacgccaagugccagaccccgcagggcgccaucaacagcucccugcccuuccagaacgugcaccccgucaccaucggcgagugccccaaguacgugcgcagcaccaagcugcggauggugacggggcuccgcaacaucccguccauccagucgcggggccuguucggggccaucgcgggcuucaucgagggcggcuggaccggcaugaucgacgggugguacggcuaccaccaccagaacgagcagggguccggcuacgccgccgaccagaaguccacccagaacgccaucaacgggaucaccaacaaggucaacagcgugaucgagaagaugaacacgcaguucaccgccgugggcaaggaguucaacaagcuggagcgccggauggagaaccucaacaagaaggucgacgacggcuuccuggacaucuggaccuacaacgcggagcugcucgugcugcuggagaacgggcgcacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcacguacgacuaccccaaguacuccgaggagucgaagcucaaccgggggaagaucgacggcgucaagcuggagagcaugggcguguaccagauccuggccaucuacuccaccguggccagcucccucguccugcuggugagccucggggccaucuccuucuggaugugcagcaacggcucccugcagugccgcaucugcaucuga

SEQ ID NO: 2587 - RNA, 1689 nt, Artificial Sequence
  derived and/or modified CDS sequence (AUadapt) from InfluenzaA__ACF54389__HA
auggccaucaucuaccugauccuccuguucgccaccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcucgcugaacgacuacgaggagcugaagcaccuccuguccagcgugaagcacuucgagaaggugcggauccugcccaaggaccgcuggacgcagcacaccaccaccgggggcuccaaggccugcgccgucucggggaagcccuccuucuuccggaacaugguguggcucacgaagaagggcaccaacuaccccguggcgaaggggucguacaacaacaccuccggcgagcagaugcugaucaucuggggcguccaccacccgaucgacgaggccgagcagcgcgcccuguaccaggagguggggaccuacgugagcgccuccacgucgacccucaacaagcgguccauccccgagaucgcggcccgccccgaggucaacggccuggggucgcggauggaguucuccuggacccugcucgacgugugggacaccaucaacuucgagagcacgggcaaccugguggcccccgaguacggcuucaagaucuccaagcgcgggucgucgggcaucaugaagaccgaggggacccugggcaacugcgagaccaagugccagacgccgcucggggccaucaacaccacccugcccuuccacaacguccacccccugaccaucggcgagugccccaaguacgugaaguccgagaagcucgugcuggccacgggccugcggaacgucccgcagaucgagucgcgcggccucuucggggcgaucgccggguucaucgagggcggguggcagggcaugguggacggcugguacggguaccaccacuccaacgagcagggcagcggguacgccgccgacaaggaguccacccagaaggccuucgacggcaucaccaacaaggugaacucggucaucgagaagaugaacacccaguucgaggcgguggggaaggaguucaacaaccuggagaagcggcuggagaaccucaacaagaagauggaggacggcuuccuggacguguggacguacaacgccgagcugcucguccugauggagaacgagcgcacccuggacuuccacgacuccaacgugaagaaccucuacgagaagguccggaugcagcugcgcgacaacgugaaggagcugggcaacgggugcuucgaguucuaccacaagugcgacgacgagugcaugaacucggugaagaacggcaccuacgacuaccccaaguacgaggaggaguccaagcucaagcggaacgagaucaagggggucaagcugagcuccaugggcguguaccagauccuggccaucuacgccaccguggccggcucgcucucccuggcgaucauggucgccgggaucucguucuggaugugcuccaacggcagccugcagugccgcaucugcaucuga

SEQ ID NO: 2588 - RNA, 1701 nt, Artificial Sequence; identical to SEQ ID NO: 2561
  derived and/or modified CDS sequence (AUadapt) from InfluenzaA__ACF54400__HA

SEQ ID NO: 2589 - RNA, 1701 nt, Artificial Sequence; identical to SEQ ID NO: 65
  derived and/or modified CDS sequence (AUadapt) from InfluenzaA__ACF54411__HA

SEQ ID NO: 2590 - RNA, 1701 nt, Artificial Sequence; identical to SEQ ID NO: 65
  derived and/or modified CDS sequence (AUadapt) from InfluenzaA__ACF54422__HA

SEQ ID NO: 2591 - RNA, 1701 nt, Artificial Sequence; identical to SEQ ID NO: 141
  derived and/or modified CDS sequence (AUadapt) from InfluenzaA__ACF54433__HA

SEQ ID NO: 2592 - RNA, 1701 nt, Artificial Sequence; identical to SEQ ID NO: 65
  derived and/or modified CDS sequence (AUadapt) from InfluenzaA__ACF54444__HA

SEQ ID NO: 2593 - RNA, 1701 nt, Artificial Sequence; identical to SEQ ID NO: 2581
  derived and/or modified CDS sequence (AUadapt) from InfluenzaA__ACF54466__HA

SEQ ID NO: 2594 - RNA, 1689 nt, Artificial Sequence
  derived and/or modified CDS sequence (AUadapt) from InfluenzaA__ACF54477__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacgcagcacaccaccaccggcgggucccgggccugcgccgucucgggcaaccccuccuucuuccgcaacaugguguggcugacgaagaaggggucgaacuaccccguggcgaagggcuccuacaacaacaccagcggcgagcagaugcucaucaucuggggcguccaccacccgaacgacgagaccgagcagcggacccuguaccagaacguggggacguacguguccgucgggaccucgacccugaacaagcgcuccacccccgacaucgccacgcggcccaaggugaacggccucggcucgcgcauggaguucuccuggacccugcuggacaugugggacaccaucaacuucgagagcaccgggaaccucaucgcccccgaguacggcuucaagaucuccaagcgggggucgucgggcaucaugaagacggaggggacccuggagaacugcgagaccaagugccagaccccgcugggcgccaucaacacgacccuccccuuccacaacgugcacccccugaccaucggcgagugccccaaguacgucaaguccgagaagcuggugcucgcgaccgggcugcgcaacgugccgcagaucgagucgcggggccuguucggggccaucgccggcuucaucgagggcggguggcagggcauggucgacgggugguacggcuaccaccacuccaacgaccaggggagcggcuacgccgccgacaaggaguccacgcagaaggcguucgacgggaucaccaacaaggugaacucggugaucgagaagaugaacacccaguucgaggccgucggcaaggaguucuccaaccucgagcgccggcuggagaaccugaacaagaagauggaggacggcuuccucgacguguggaccuacaacgccgagcugcuggugcucauggagaacgagcgcacgcuggacuuccacgacucgaacgucaagaaccuguacgacaaggugcggaugcagcuccgcgacaacgucaaggagcuggggaacggcugcuucgaguucuaccacaagugcgacgacgagugcaugaacuccgugaagaacgggaccuacgacuaccccaaguacgaggaggagagcaagcugaaccggaacgagaucaagggcgugaagcucuccucgaugggcgucuaccagauccuggccaucuacgccaccguggcggggucccugucgcucgccaucaugauggccggcaucuccuucuggaugugcagcaacgggucccugcagugccgcaucugcaucuga

SEQ ID NO: 2595 - RNA, 1689 nt, Artificial Sequence
  derived and/or modified CDS sequence (AUadapt) from InfluenzaA__ACF54499__HA
auggccaucaucuaccugauccuccuguucaccgccgugcgcggcgaccagaucugcaucggguaccacgcgaacaacucgaccgagacggucgacaccauccuggagcggaacgugaccgugacccacgccaaggacauccucgagaagacgcacaacggcaagcugugcaagcugaacgggaucccgccccucgagcugggcgacugcuccaucgccggguggcugcucggcaaccccgagugcgaccgccugcugucgguccccgagugguccuacaucauggagaaggagaacccccgggacggccucugcuacccggggucguucaacgacuacgaggagcugaagcaccuccuguccagcgugaagcacuucgagaaggugaagauccugcccaaggaccgcuggacccagcacaccaccacgggcgggucccgggccugcgccgucucgggcaaccccuccuucuuccgcaacaugguguggcugaccaagaaggggucgaacuaccccguggcgaagggcuccuacaacaacaccagcggcgagcagaugcucaucaucuggggcguccaccacccgaacgacgagaccgagcagcggacgcuguaccagaacguggggaccuacguguccgucgggaccucgacccugaacaagcgcuccacgcccgacaucgccacccggcccaaggugaacggccucggcucgcgcauggaguucuccuggacccugcuggacaugugggacaccaucaacuucgagagcacggggaaccucaucgcccccgaguacggcuucaagaucuccaagcgggggucgucgggcaucaugaagaccgaggggacccuggagaacugcgagaccaagugccagacgccgcugggcgccaucaacaccacccuccccuuccacaacgugcacccccugaccaucggcgagugccccaaguacgucaaguccgagaagcuggugcucgcgacggggcugcgcaacgugccgcagaucgagucgcggggccuguucggggccaucgccggcuucaucgagggcggguggcagggcauggucgacgggugguacggcuaccaccacuccaacgaccaggggagcggcuacgccgccgacaaggaguccacccagaaggcguucgacgggaucaccaacaaggugaacucggugaucgagaagaugaacacccaguucgaggccgucggcaaggaguucuccaaccucgagcgccggcuggagaaccugaacaagaagauggaggacggcuuccucgacguguggacguacaacgccgagcugcuggugcucauggagaacgagcgcacccuggacuuccacgacucgaacgucaagaaccuguacgacaaggugcggaugcagcuccgcgacaacgucaaggagcuggggaacggcugcuucgaguucuaccacaagugcgacgacgagugcaugaacuccgugaagaacgggaccuacgacuaccccaaguacgaggaggagagcaagcugaaccggaacgagaucaagggcgugaagcucuccucgaugggcgucuaccagauccuggccaucuacgccaccguggcggggucccugucgcucgccaucaugauggccggcaucuccuucuggaugugcagcaacgggucccugcagugccgcaucugcaucuga

SEQ ID NO: 2596 - RNA, 1689 nt, Artificial Sequence; identical to SEQ ID NO: 2595
  derived and/or modified CDS sequence (AUadapt) from InfluenzaA__ACF54510__HA

SEQ ID NO: 2597 - RNA, 1689 nt, Artificial Sequence; identical to SEQ ID NO: 2595
  derived and/or modified CDS sequence (AUadapt) from InfluenzaA__ACF54521__HA

SEQ ID NO: 2598 - RNA, 1701 nt, Artificial Sequence
  derived and/or modified CDS sequence (AUadapt) from InfluenzaA__ACF54532__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugacgucgggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2599 - RNA, 1701 nt, Artificial Sequence
  derived and/or modified CDS sequence (AUadapt) from InfluenzaA__ACF54543__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgucagccugcggucccucguggcgucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgucaccaugcccaacaacgagaacuucgacaagcucuacaucuggggcgugcaccaccccgggaccgacaacgaccagaucuuccuguacgcccaggcgucggggcggaucaccguguccacgaagcgcagccagcagaccgucaucccgaacaucggcucgcggccccgcgugcggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgcgaucgccggguucaucgagaacggcugggagggcauggucgacgggugguacggcuuccgccaccagaacagcgaggggaucggccaggccgccgaccugaaguccacccaggccgcgaucgaccagaucaacgggaagcugaaccggcucaucggcaagaccaacgagaaguuccaccagaucgagaaggaguucucggagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggaccucgggaacggcugcuucaagaucuaccacaagugcgacaacgccugcaucggguccauccgcaacggcaccuacgaccacgacguguaccgcgacgaggcgcugaacaaccgguuccagaucaaggggguggagcugaaguccggcuacaaggacuggauccucuggaucuccuucgccaucagcugcuuccugcugugcgucgcccuccugggcuucaucaugugggccugccagaaggggaacauccgcugcaacaucugcaucuga

SEQ ID NO: 2600 - RNA, 1701 nt, Artificial Sequence
  derived and/or modified CDS sequence (AUadapt) from InfluenzaA__ACF54565__HA
augaagaccaucaucgcccugucguacauccucugccugguguucucccagaagcugcccggcaacgacaacucgaccgccacgcucugccuggggcaccacgcggucccgaacggcaccaucgugaagaccaucaccaacgaccagaucgaggugacgaacgccaccgagcugguccaguccagcuccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgccucccugcggucgcucgucgcguccagcgggacgcuggaguucaacaacgaguccuucaacugggccggcgugacccagaacgggaccucguccgccugcaagcgccggucgaacaaguccuucuucagccgccugaacuggcucacccaccugaaguacaaguaccccgcccugaacgugacgaugcccaacaacgagaaguucgacaagcucuacaucuggggcguccaccaccccgugaccgacuccgaccagaucucgcuguacgcgcaggccagcgggcggaucaccguguccaccaagcgcucgcagcagacggucaucccgaacaucggcuaccggccccgcgugcgggacaucuccagccgcaucuccaucuacuggaccaucgugaagcccggcgacauccugcucaucaacucgaccgggaaccugaucgcgccccggggcuacuucaagauccgcuccggcaagucguccaucaugcggagcgacgccccgaucgggaagugcaacuccgagugcaucacccccaacggcucgauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggucguacaacgccgagcuccuggucgcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgagagcauccgcaacgggaccuacgaccacgacguguaccgggacgaggcccucaacaaccgcuuccagaucaagggcguggagcugaaguccggguacaaggacuggauccuguggaucucguucgccaucagcugcuuccuccugugcgucgcccugcucggcuucaucaugugggccugccagaagggcaacauccggugcaacaucugcaucuga

SEQ ID NO: 2601 - RNA, 1701 nt, Artificial Sequence
  derived and/or modified CDS sequence (AUadapt) from InfluenzaA__ACF54576__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacgacgagagcuucaacuggaccggcgugacccagaacgggaccuccucguccugcaagcgccggagcaacaacuccuucuucucgcgccugaacuggcucacgcagcugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcucgcagcagaccgucaucccgaacaucggcucccggccccgcauccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 2602 - RNA, 1698 nt, Artificial Sequence
  derived and/or modified CDS sequence (AUadapt) from InfluenzaA__ACF54598__HA
augaaggccaagcugcucgugcugcuguacgccuucgucgcgaccgacgccgacaccaucugcaucggcuaccacgccaacaacucgacggacaccguggacaccaucuucgagaagaacguggccgucacccacuccgugaaccuccuggaggaccgccacaacgggaagcugugcaagcucaagggcaucgcgccccugcagcuggggaagugcaacaucaucggcuggcuccuggggaacccggagugcgacagccugcuccccgcccgguccuggagcuacaucguggagacgcccaacuccgagaacggcgccugcuaccccggcgacuucaucgacuacgaggagcugcgcgagcagcugagcuccgucucgucccucgagcgguucgagaucuucccgaaggagagcuccuggcccaaccacaccuucaacggggugaccgccagcugcucccaccgcggcaagagcuccuucuaccggaaccugcuguggcucaccaagaagggggacucguaccccaagcugacgaacuccuacgugaacaacaagggcaaggagguccuggugcucuggggcgugcaccaccccagcuccagcgacgagcagcagagccuguacuccaacgggaacgccuacgucagcguggcguccucgaacuacaaccgccgguucaccccggagaucgccgcccgccccaaggugaaggaccagcacggccggaugaacuacuacuggacccugcucgagcccggggacaccaucaucuucgaggccacgggcaaccugaucgcccccugguacgcguucgcccugucccgcggguucgagagcggcaucaucaccuccaacgccagcaugcacgagugcaacaccaagugccagaccccgcagggcuccaucaacagcaaccuccccuuccagaacauccaccccgucacgaucggggagugccccaaguacgugcgguccaccaagcugcgcauggugaccggccugcggaacaucccgucgauccaguaccgcggccucuucggggccaucgccggguucaucgagggcggcuggaccgggaugaucgacggcugguacggguaccaccaccagaacgagcagggcuccggguacgcggccgaccagaaguccacgcagaacgccaucaacggcaucaccaacaaggucaacagcaucaucgagaagaugaacacccaguucaccgccgugggcaaggaguucaacaaccuggagaagcggauggagaaccugaacaagaagguggacgacggguuccucgacaucuggacguacaacgccgagcugcugguccuccuggagaacggccgcacccuggacuuccacgaccucaacgugaagaaccuguacgagaaggucaagagccagcugaagaacaacgcgaaggagaucgggaacggcugcuucgaguucuaccacaagugcgacaacgagugcauggaguccgugcggaacgggaccuacgacuaccccaaguacagcgaggaguccaagcucaaccgcgagaagaucgacggcgugaagcuggagucgaugggcgucuaccagauccuggccaucuacagcaccguggccuccagccucgugcugcuggucucccucggggccaucagcuucuggaugugcuccaacggcagccugcagugccggaucugcaucuga

SEQ ID NO: 2603 - RNA, 1704 nt, Artificial Sequence
  derived and/or modified CDS sequence (AUadapt) from InfluenzaA__ACG50699__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaugguggagaaggccaaccccgccaacgaccugugcuaccccgggaacuucaacgacuacgaggagcugaagcaccuccugucccggaucaaccacuucgagaagauccagaucauccccaagucguccuggagcgaccacgaggccucccugggcgucucguccgcgugcccguaccagggcagcuccucguucuuccgcaacgugguguggcucaucaagaagaacaacgccuaccccaccaucaagcgguccuacaacaacacgaaccaggaggaccugcugguccucugggggauccaccaccccaacgacgaggccgagcagacccgccuguaccagaacccgaccaccuacaucagcgugggcacguccacccugaaccagcggcucauccccaagaucgccacccgcucgaaggugaacgggcaguccggccggauggacuucuucuggaccauccugaagcccaacgacgcgaucaacuucgagagcaacgggaacuucaucgcccccgaguacgccuacaagaucgucaagaagggcgacucggccaucaugaaguccgagguggaguacggcaacugcaacacgaagugccagaccccgaugggggccaucaacagcuccaugcccuuccacaacauccacccccugaccaucggcgagugccccaaguacgucaagucgaacaagcucgugcuggcgaccgggcugcgcaacuccccgcagcgggagcgccggcgcaagcggggccucuucggcgccaucgccggguucaucgagggcggguggcagggcaugguggacgggugguacggcuaccaccacagcaacgagcagggcuccggguacgccgccgacaaggagucgacgcagaaggcgaucgacggcgugaccaacaaggucaacuccaucaucgacaagaugaacacccaguucgaggccguggggcgcgaguucaacaaccuggagcggcgcaucgagaaccugaacaagaagauggaggacggcuuccucgacguguggaccuacaacgccgagcugcugguccucauggagaacgagcggacgcuggacuuccacgacagcaacgugaagaaccuguacgacaagguccgccuccagcugcgggacaacgccaaggagcuggggaacggcugcuucgaguucuaccacaagugcgacaacgagugcauggaguccgugcgcaacggcaccuacgacuacccccaguacucggaggaggcccggcucaagcgcgaggagaucuccggggugaagcuggagagcaucggcaccuaccagauccuguccaucuacucgaccgucgcguccagccucgcccuggccaucaugguggccgggcugucccucuggaugugcucgaacggcagccugcagugccgcaucugcaucuga

SEQ ID NO: 2604 - RNA, 1701 nt, Artificial Sequence; identical to SEQ ID NO: 2173
  derived and/or modified CDS sequence (AUadapt) from InfluenzaA__ACG70142__HA

SEQ ID NO: 2605 - RNA, 1701 nt, Artificial Sequence; identical to SEQ ID NO: 2173
  derived and/or modified CDS sequence (AUadapt) from InfluenzaA__ACG70153__HA

SEQ ID NO: 2606 - RNA, 1701 nt, Artificial Sequence
  derived and/or modified CDS sequence (AUadapt) from InfluenzaA__ACG80410__HA
augaagaccaucaucgcccugucguacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgucgcugcgcucccucgucgccucguccggcacgcuggaguucaacaacgagagcuucaacuggaccggggugacccagaacggcaccuccucggccugcauccggcgcuccaacaacagcuucuucucccggcugaacuggcucacgcaccuccgcuucaaguaccccgcccugaacgugaccaugcccaacaacgagcaguucgacaagcuguacaucuggggcguccaccaccccgggaccgacaacgaccagaucuuccuguacgcgcaggccucggggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 2607 - RNA, 1701 nt, Artificial Sequence
  derived and/or modified CDS sequence (AUadapt) from InfluenzaA__ACG80420__HA
augcagaccaucaucgcccugucguacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgucgcugcgcucccucgucgccucguccggcacgcuggaguucaacaacgagagcuucaacuggaccggggugacccagaacggcaccuccucggccugcauccggcgcuccaacaacagcuucuucucccggcugaacuggcucacgcaccuccgcuucaaguaccccgcccugaacgugaccaugcccaacaacgagcaguucgacaagcuguacaucuggggcguccaccaccccgggaccgacaacgaccagaucuuccuguacgcgcaggccucggggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 2608 - RNA, 1701 nt, Artificial Sequence; identical to SEQ ID NO: 2606
  derived and/or modified CDS sequence (AUadapt) from InfluenzaA__ACG80426__HA

SEQ ID NO: 2609 - RNA, 1701 nt, Artificial Sequence; identical to SEQ ID NO: 2606
  derived and/or modified CDS sequence (AUadapt) from InfluenzaA__ACG80430__HA

SEQ ID NO: 2610 - RNA, 1701 nt, Artificial Sequence
  derived and/or modified CDS sequence (AUadapt) from InfluenzaA__ACG80436__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcgagaacugcacccucaucgacgcccugcugggggacccccagugcgacggcuuccagaacaagaagugggaccucuucguggagcgcucgaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgccgguccaacaacagcuucuucucccgccugaacuggcugacgcaccuccgguucaaguaccccgcccugaacgugaccaugcccaacaacgagaacuucgacaagcuguacaucuggggcguccaccaccccgggaccgacaacgaccagaucuuccucuacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaacucggagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccucaaguccacccaggcggcccuggaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacaacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2611 - RNA, 1701 nt, Artificial Sequence
  derived and/or modified CDS sequence (AUadapt) from InfluenzaA__ACG80445__HA
augaagaccaucaucgcccugucguacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgucgcugcgcucccucgucgccucguccggcacgcuggaguucaacaacgagagcuucaacuggaccggggugacccagaacggcaccuccucggccugcauccggcgcuccaacaacagcuucuucucccggcugaacuggcucacgcaccuccgcuucaaguaccccgcccugaacgugaccaugcccaacaacgagcaguucgacaagcuguacaucuggggcguccaccaccccgggaccgacaacgaccagaucuuccuguacgcgcaggccucggggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaaccagcugcgggagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 2612 - RNA, 1701 nt, Artificial Sequence; identical to SEQ ID NO: 2606
  derived and/or modified CDS sequence (AUadapt) from InfluenzaA__ACG80454__HA

SEQ ID NO: 2613 - RNA, 1701 nt, Artificial Sequence; identical to SEQ ID NO: 2606
  derived and/or modified CDS sequence (AUadapt) from InfluenzaA__ACG80463__HA

SEQ ID NO: 2614 - RNA, 1701 nt, Artificial Sequence
  derived and/or modified CDS sequence (AUadapt) from InfluenzaA__ACG80472__HA
augaagaccaucaucgcccugucguacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgucgcugcgcucccucgucgccagcuccggcacgcuggaguucaacaacgagucguucaacuggaccggggugacccagaacggcaccuccagcgccugcauccggcgcuccaacaacucguucuucucccggcugaacuggcucacgcaccuccgcuucaaguaccccgcccugaacgugaccaugcccaacaacgagcaguucgacaagcuguacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggcccuggaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacucggagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 2615 - RNA, 1701 nt, Artificial Sequence
  derived and/or modified CDS sequence (AUadapt) from InfluenzaA__ACH69558__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcaacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccuccgguucaaguaccccgcccugaacgugaccaugcccaacaacgagaaguucgacaagcuguacaucuggggcguccaccaccccgggaccgacaacgaccagaucuuccuguacgcgcaggccucgggccgcaucaccguguccacgaagcggagccagcagaccgugaucccgaacaucggcucgcgcccccggguccgcaacauccccucccggaucagcaucuacuggaccaucgugaagcccggggacauccugcucaucaacuccaccggcaaccugaucgccccgcgcggguacuucaagauccggucgggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 2616 - RNA, 1701 nt, Artificial Sequence
  derived and/or modified CDS sequence (AUadapt) from InfluenzaA__ACH69569__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcaacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacucgcugaagcucgcgaccgggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacgcaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 2617 - RNA, 1701 nt, Artificial Sequence
  derived and/or modified CDS sequence (AUadapt) from InfluenzaA__ACH69580__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacgacuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2618 - RNA, 1701 nt, Artificial Sequence
  derived and/or modified CDS sequence (AUadapt) from InfluenzaA__ACH69591__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccucgcuccgcucccugguggccagcuccggcacgcuggaguucaacaacgagucguucaacuggaccggggucgcccagaacggcaccuccagcgcgugcaagcggcgcuccaucaacucguucuucucccggcucaacuggcugcaccagcugaaguaccgcuaccccgcccucaacgugaccaugcccaacaacgacaaguucgacaagcuguacaucuggggcgugcaccaccccagcacggacuccgaccagaucucggucuacgcccaggccagcgggcgggugaccguguccaccaagcgcucgcagcagaccgucaucccgaacaucgggucccggcccugggugcgcggcaucagcucccggaucucgaucuacuggacgaucgugaagcccggcgacauccugcucaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacucggaggggaccggccaggcggccgaccugaaguccacgcaggccgccaucaaccagaucaacgggaagcugaacaagcucaucgagaagaccaacgagaaguuccaccagaucgagaacgaguucagcgaggucgagggccgcauccaggaccuggagaaguacguggaggacaccaagaucgaccugugguccuacaacgccgagcuccugguggcgcuggagaaccagcacaccaucgaccucacggacucggagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 2619 - RNA, 1701 nt, Artificial Sequence
  derived and/or modified CDS sequence (AUadapt) from InfluenzaA__ACH69602__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccucgcuccgcucccugguggccagcuccggcacgcuggaguucaacaacgagucguucaacuggaccggggucgcccagaacggcaccuccagcgcgugcaagcggcgcuccaucaacucguucuucucccggcucaacuggcugcaccagcugaaguaccgcuaccccgcccucaacgugaccaugcccaacaacgacaaguucgacaagcuguacaucuggggcgugcaccaccccagcacggacuccgaccagaucucggucuacgcccaggccagcgggcgggugaccguguccaccaagcgcucgcagcagaccgucaucccgaacaucgggucccggcccugggugcgcggcaucagcucccggaucucgaucuacuggacgaucgugaagcccggcgacauccugcucaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacucggaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacucggagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 2620 - RNA, 1701 nt, Artificial Sequence
  derived and/or modified CDS sequence (AUadapt) from InfluenzaA__ACH69613__HA
augaagaccaucaucgcccugucguacauccucugccuggccuucgcgcagaagcugcccggcaacgacaacuccaccccgacgcucugccuggggcaccacgccgugcccaacggcacccuggucaagaccaucaccaacgaccagaucgaggugacgaacgccaccgagcucgugcagucguccagcaccgggggcaucugcgacucgccccaccagaucaucgacggggagaacugcacccugaucgacgcccugcucggcgacccccacugcgacggcuuccagaacaaggagugggaccuguucgucgagcgcuccaaggccuacuccaacugcuacccguacgacgugcccgacuacgcgucgcugcggucccucguggccagcuccgggacgcuggaguucaacaacgagucguucaacuggaccggcgucgcccagaacgggaccuccagcgccugcaagcgccgguccaucaacucguucuucucccgccugaacuggcuccaccagcugaaguaccgguaccccgcgcugaacgugaccaugcccaacaacgacaaguucgacaagcucuacaucuggggcgugcaccacccgucgacggacuccgaccagaucagcgucuacgcccaggccucggggcgcgugaccguguccaccaagcggagccagcagaccgucauccccaacaucggcucccgccccugggugcggggcaucucgucccgcaucucgaucuacuggacgaucgugaagcccggggacauccugcugaucaacuccaccggcaacccgaucgcgccccggggguacuucaagauccgcagcggcaaguccucgaucaugcgguccgacgcccccaucggcaagugcaacagcgagugcaucacccccaacggguccaucccgaacgacaagcccuuccagaacgucaaccgcaucaccuacggcgccugcccccgguacgugaagcagaacacgcucaagcuggccaccgggaugcgcaacgugcccgagaagcagacccggggcaucuucggggccaucgccggcuucaucgagaacggcugggaggggaugauggacggcugguacgggcugcgccaccagaacucggagggcaccgggcaggccgcggaccucaaguccacgcaggccgccaucaaccagaucaacggcaagcugaacaagcugaucgagaagaccaacgagaaguuccaccagaucgagaacgaguucucggaggucgagggccggauccaggaccucgagaaguacguggaggacaccaagaucgaccugugguccuacaacgccgagcugcucguggcccuggagaaccagcacaccaucgaccugacggacagcgagaugaacaagcuguucgagcgcacccggaagcagcuccgcgagaacgcggaggacauggggaacggcugcuucaagaucuaccacaagugcgacaacgccugcaucggguccauccgcaacggcaccuacgaccacgacgucuaccgggacgaggcccugaacaaccgcuuccagaucaaggggguggagcucaagucgggcuacaaggacuggauccuguggaucagcuucgccaucuccugcuuccugcucugcgugguccugcugggcuucaucaugugggccugccagaaggggaacauccggugcaacaucugcaucuga

SEQ ID NO: 2621 - RNA, 1701 nt, Artificial Sequence; identical to SEQ ID NO: 875
  derived and/or modified CDS sequence (AUadapt) from InfluenzaA__ACH82060__HA

SEQ ID NO: 2622 - RNA, 1701 nt, Artificial Sequence; identical to SEQ ID NO: 2561
  derived and/or modified CDS sequence (AUadapt) from InfluenzaA__ACI06123__HA

SEQ ID NO: 2623 - RNA, 1701 nt, Artificial Sequence; identical to SEQ ID NO: 2561
  derived and/or modified CDS sequence (AUadapt) from InfluenzaA__ACI06126__HA

SEQ ID NO: 2624 - RNA, 1701 nt, Artificial Sequence; identical to SEQ ID NO: 2561
  derived and/or modified CDS sequence (AUadapt) from InfluenzaA__ACI06127__HA

SEQ ID NO: 2625 - RNA, 1701 nt, Artificial Sequence; identical to SEQ ID NO: 2561
  derived and/or modified CDS sequence (AUadapt) from InfluenzaA__ACI06129__HA

SEQ ID NO: 2626 - RNA, 1701 nt, Artificial Sequence; identical to SEQ ID NO: 2561
  derived and/or modified CDS sequence (AUadapt) from InfluenzaA__ACI06130__HA

SEQ ID NO: 2627 - RNA, 1701 nt, Artificial Sequence; identical to SEQ ID NO: 2561
  derived and/or modified CDS sequence (AUadapt) from InfluenzaA__ACI06132__HA

SEQ ID NO: 2628 - RNA, 1701 nt, Artificial Sequence; identical to SEQ ID NO: 65
  derived and/or modified CDS sequence (AUadapt) from InfluenzaA__ACI06133__HA

SEQ ID NO: 2629 - RNA, 1701 nt, Artificial Sequence; identical to SEQ ID NO: 65
  derived and/or modified CDS sequence (AUadapt) from InfluenzaA__ACI06134__HA

SEQ ID NO: 2630 - RNA, 1701 nt, Artificial Sequence; identical to SEQ ID NO: 65
  derived and/or modified CDS sequence (AUadapt) from InfluenzaA__ACI06135__HA

SEQ ID NO: 2631 - RNA, 1701 nt, Artificial Sequence; identical to SEQ ID NO: 65
  derived and/or modified CDS sequence (AUadapt) from InfluenzaA__ACI06136__HA

SEQ ID NO: 2632 - RNA, 1701 nt, Artificial Sequence; identical to SEQ ID NO: 65
  derived and/or modified CDS sequence (AUadapt) from InfluenzaA__ACI06137__HA

SEQ ID NO: 2633 - RNA, 1701 nt, Artificial Sequence; identical to SEQ ID NO: 65
  derived and/or modified CDS sequence (AUadapt) from InfluenzaA__ACI06138__HA

SEQ ID NO: 2634 - RNA, 1701 nt, Artificial Sequence; identical to SEQ ID NO: 65
  derived and/or modified CDS sequence (AUadapt) from InfluenzaA__ACI06139__HA

SEQ ID NO: 2635 - RNA, 1701 nt, Artificial Sequence; identical to SEQ ID NO: 65
  derived and/or modified CDS sequence (AUadapt) from InfluenzaA__ACI06140__HA

SEQ ID NO: 2636 - RNA, 1701 nt, Artificial Sequence; identical to SEQ ID NO: 65
  derived and/or modified CDS sequence (AUadapt) from InfluenzaA__ACI06141__HA

SEQ ID NO: 2637 - RNA, 1701 nt, Artificial Sequence; identical to SEQ ID NO: 65
  derived and/or modified CDS sequence (AUadapt) from InfluenzaA__ACI06142__HA

SEQ ID NO: 2638 - RNA, 1701 nt, Artificial Sequence; identical to SEQ ID NO: 65
  derived and/or modified CDS sequence (AUadapt) from InfluenzaA__ACI06143__HA

SEQ ID NO: 2639 - RNA, 1701 nt, Artificial Sequence
  derived and/or modified CDS sequence (AUadapt) from InfluenzaA__ACI06144__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaaccggcuguucgagaagacgcgccggcagcugcgcgagaacgccgaggacauggggaacggcugcuucaagaucuaccacaagugcgacaacgccugcaucgaguccauccgcaacggcaccuacgaccacgacguguaccgggacgaggcccucaacaaccgcuuccagaucaagggggucgagcucaagucgggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 2640 - RNA, 1701 nt, Artificial Sequence; identical to SEQ ID NO: 65
  derived and/or modified CDS sequence (AUadapt) from InfluenzaA__ACI06145__HA

SEQ ID NO: 2641 - RNA, 1701 nt, Artificial Sequence
  derived and/or modified CDS sequence (AUadapt) from InfluenzaA__ACI06146__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucggcagcucccccugggugcgcggccugucgucccggaucagcaucuacuggaccaucgucaagcccggggacgugcucgugaucaacuccaacggcaaccugaucgcgccgcgcggguacuucaagaugcggaccggcaagucguccaucaugcgcagcgacgcccccaucgacacgugcaucuccgagugcaucacccccaacgggucgauccccaacgacaagccguuccagaacgucaacaagaucaccuacggcgccugccccaaguacgugaagcagaacacccugaagcucgccacgggcaugcggaacgugcccgagaagcagacccgcgggcuguucggcgccaucgcgggguucaucgagaacggcugggaggggaugaucgacggcugguacggcuuccggcaccagaacuacgaggggaccggccaggccgccgaccugaaguccacccaggccgccaucgaccagaucaacgggaagcucaaccgcgucaucgagaagacgaacgagaaguuccaccagaucgagaaggaguucagcgagguggagggccggauccaggaccuggagaaguacguggaggacaccaagaucgaccugugguccuacaacgcggagcuccuggucgcccuggagaaccagcacaccaucgaccucaccgacucggagaugaacaagcuguucgagaagacgcgccggcagcugcgcgagaacgccgaggacauggggaacggcugcuucaagaucuaccacaagugcgacaacgccugcaucgaguccauccggaacggcaccuacgaccacgacguguaccgcgacgaggcccucaacaaccgcuuccagaucaagggggucgagcucaagagcggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 2642 - RNA, 1701 nt, Artificial Sequence; identical to SEQ ID NO: 65
  derived and/or modified CDS sequence (AUadapt) from InfluenzaA__ACI06147__HA

SEQ ID NO: 2643 - RNA, 1701 nt, Artificial Sequence; identical to SEQ ID NO: 65
  derived and/or modified CDS sequence (AUadapt) from InfluenzaA__ACI06148__HA

SEQ ID NO: 2644 - RNA, 1701 nt, Artificial Sequence
  derived and/or modified CDS sequence (AUadapt) from InfluenzaA__ACI06149__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccgccagaccaucauccccaacaucggcucgcggcccugggugcgcggccuguccagccggaucuccaucuacuggaccaucgucaagcccggggacgugcucgugaucaacucgaacggcaaccugaucgcgccgcgcggguacuucaagaugcggaccggcaaguccagcaucaugcgcuccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcggaacgugcccgagaagcagacccgcgggcuguucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcucaaccgcgucaucgagaagacgaacgagaaguuccaccagaucgagaaggaguucucggagguggagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuaccacaagugcgacaacgccugcaucgaguccauccgcaacggcaccuacgaccacgacguguaccgggacgaggcccucaacaaccgcuuccagaucaagggggucgagcucaagucgggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 2645 - RNA, 1701 nt, Artificial Sequence; identical to SEQ ID NO: 141
  derived and/or modified CDS sequence (AUadapt) from InfluenzaA__ACI06151__HA

SEQ ID NO: 2646 - RNA, 1701 nt, Artificial Sequence; identical to SEQ ID NO: 141
  derived and/or modified CDS sequence (AUadapt) from InfluenzaA__ACI06152__HA

SEQ ID NO: 2647 - RNA, 1701 nt, Artificial Sequence
  derived and/or modified CDS sequence (AUadapt) from InfluenzaA__ACI06153__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucggcagccgccccugggugcggggccuguccucgcgcaucuccaucuacuggaccaucgucaagcccggggacgagcucgugaucaacagcaacggcaaccugaucgcgccgcggggguacuucaagaugcgcaccggcaaguccucgaucaugcgguccgacgcccccaucgacacgugcaucucggagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucucggaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagucgggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 2648 - RNA, 1701 nt, Artificial Sequence
  derived and/or modified CDS sequence (AUadapt) from InfluenzaA__ACI06155__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucgagucgcgccccugggugcggggccuguccagccgcaucuccaucuacuggaccaucgucaagcccggcgacgugcucgugaucaacucgaacgggaaccugaucgcgccgcggggcuacuucaagaugcgcaccgggaaguccagcaucguccgguccgacgcccccaucgacacgugcaucucggagugcaucacccccaacggcuccauccccaacgacaagccguuccagaacgugaacaagaucaccuacggggccugccccaaguacgugaagcagaacacccugaagcucgccacgggcaugcgcaacguccccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggugaucgagaagacgaacgagaaguuccaccagaucgagaaggaguucucggagguggaggggcgcauccaggaccuggagaaguacgucgaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacgucuaccgcgacgaggcccucaacaaccgguuccagaucaagggcguggagcucaagucgggguacaaggacuggauccuguggaucuccuucgcgaucagcugcuuccugcugugcgugguccugcucggcuucaucaugugggccugccagcgcgggaacauccggugcaacaucugcaucuga

SEQ ID NO: 2649 - RNA, 1701 nt, Artificial Sequence; identical to SEQ ID NO: 141
  derived and/or modified CDS sequence (AUadapt) from InfluenzaA__ACI06156__HA

SEQ ID NO: 2650 - RNA, 1701 nt, Artificial Sequence; identical to SEQ ID NO: 141
  derived and/or modified CDS sequence (AUadapt) from InfluenzaA__ACI06157__HA

SEQ ID NO: 2651 - RNA, 1701 nt, Artificial Sequence; identical to SEQ ID NO: 141
  derived and/or modified CDS sequence (AUadapt) from InfluenzaA__ACI06158__HA

SEQ ID NO: 2652 - RNA, 1701 nt, Artificial Sequence; identical to SEQ ID NO: 141
  derived and/or modified CDS sequence (AUadapt) from InfluenzaA__ACI06159__HA

SEQ ID NO: 2653 - RNA, 1701 nt, Artificial Sequence; identical to SEQ ID NO: 65
  derived and/or modified CDS sequence (AUadapt) from InfluenzaA__ACI06160__HA

SEQ ID NO: 2654 - RNA, 1701 nt, Artificial Sequence
  derived and/or modified CDS sequence (AUadapt) from InfluenzaA__ACI06161__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucgagucgcgccccugggugcggggccuguccagccgcaucuccaucuacuggaccaucgucaagcccggcgacgugcucgugaucaacucgaacgggaaccugaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucucggagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaagggcaccuacgaccacgacguguaccgcgacgaggcccucaacaaccgguuccagaucaagggcgucgagcucaagucgggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 2655 - RNA, 1701 nt, Artificial Sequence
  derived and/or modified CDS sequence (AUadapt) from InfluenzaA__ACI06162__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucgagucgcgccccugggugcggggccuguccagccgcaucuccaucuacuggaccaucgucaaccccggcgacgugcucgugaucaacucgaacgggaaccugaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucucggagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagucgggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 2656 - RNA, 1701 nt, Artificial Sequence
  derived and/or modified CDS sequence (AUadapt) from InfluenzaA__ACI06163__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaagggcaccuacgaccacgacguguaccgcgacgaggcccucaacaaccgguuccagaucaagggggucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 2657 - RNA, 1701 nt, Artificial Sequence
  derived and/or modified CDS sequence (AUadapt) from InfluenzaA__ACI06164__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggucgcagcagaccaucauccccaacaucggcagccgccccugggugcggggccuguccucgcgcaucaacaucuacuggaccaucgucaagcccggggacgugcucgugaucaacuccaacggcaaccugaucgcgccgcggggguacuucaagaugcgcaacggcaagagcuccaucaugcggucggacgcccccaucgacacgugcaucuccgagugcaucacccccaacgggagcauccccaacgacaagccguuccagaacgucaacaagaucaccuacggcgccugccccaaguacgugaagcagaacacccugaagcucgccaccggcaugcgcaacgugcccgagaagcagacgcgggggcuguucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggucaucgagaagaccaacgagaaguuccaccagaucgagaaggaguucuccgagguggagggccgcauccaggaccuggagaaguacguggaggacacgaagaucgaccuguggagcuacaacgcggagcuccuggucgcccuggagaaccagcacaccaucgaccucaccgacuccgagaugaacaagcuguucgagaagacccggcgccagcugcgggagaacgccgaggacauggggaacggcugcuucaagaucuaccacaagugcgacaacgccugcaucgagucgauccgcaacggcacguacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 2658 - RNA, 1701 nt, Artificial Sequence
  derived and/or modified CDS sequence (AUadapt) from InfluenzaA__ACI06165__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaacggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccaccggcaugcgcaacgugcccgagaagcagacgcgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagaccaacgagaaguuccaccagaucgagaaggaguucucggagguggagggccgcauccaggaccuggagaaguacguggaggacacgaagaucgaccugugguccuacaacgcggagcuccuggucgcccuggagaaccagcacaccaucgaccucaccgacagcgagaugaacaagcuguucgagaagacccggcgccagcugcgggagaacgccgaggacauggggaacggcugcuucaagaucuaccacaagugcgacaacgccugcaucgaguccauccgcaacggcacguacgaccacgacguguaccgcgacgaggcccucaacaaccgguuccagaucaagggggucgagcucaagucgggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 2659 - RNA, 1701 nt, Artificial Sequence
  derived and/or modified CDS sequence (AUadapt) from InfluenzaA__ACI06166__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggucgcagcagaccaucauccccaacaucggcagccgccccuggauccggggccuguccucgcgcaucaacaucuacuggaccaucgugaagcccggggacguccucgugaucaacuccaacggcaaccugaucgcgccgcggggguacuucaagaugcgcaacggcaagagcuccaucaugcggucggacgcccccaucgacacgugcaucuccgagugcaucacccccaacgggagcauccccaacgacaagccguuccagaacgugaacaagaucaccuacggcgccugccccaaguacgucaagcagaacacccugaagcucgccaccggcaugcgcaacgugcccgagaagcagacgcgggggcuguucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggugaucgagaagaccaacgagaaguuccaccagaucgagaaggaguucuccgaggucgagggccgcauccaggaccuggagaaguacguggaggacacgaagaucgaccuguggagcuacaacgcggagcuccugguggcccuggagaaccagcacaccaucgaccucaccgacuccgagaugaacaagcuguucgagaagacccggcgccagcugcgggagaacgccgaggacauggggaacggcugcuucaagaucuaccacaagugcgacaacgccugcaucgagucgauccgcaacggcacguacgaccacgacgucuaccgcgacgaggcccucaacaaccgguuccagaucaaggggguggagcugaaguccggcuacaaggacuggauccuguggaucagcuucgcgaucuccugcuuccuccugugcgucgugcugcucggguucaucaugugggccugccagcgcggcaacauccggugcaacaucugcaucuga

SEQ ID NO: 2660 - RNA, 1701 nt, Artificial Sequence; identical to SEQ ID NO: 2644
  derived and/or modified CDS sequence (AUadapt) from InfluenzaA__ACI06167__HA

SEQ ID NO: 2661 - RNA, 1701 nt, Artificial Sequence
  derived and/or modified CDS sequence (AUadapt) from InfluenzaA__ACI06168__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucggcucgcgccccugggugcggggccuguccagccgcaucuccaucuacuggaccaucgucaagcccggggacgugcucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggaagcagcugcgcgagaacgccgaggacauggggaacggcugcuucaagaucuaccacaagugcgacaacgccugcaucgaguccauccggaacggcaccuacgaccacgacguguaccgcgacgaggcccucaacaaccgcuuccagaucaagggggucgagcucaagucgggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 2662 - RNA, 1701 nt, Artificial Sequence; identical to SEQ ID NO: 65
  derived and/or modified CDS sequence (AUadapt) from InfluenzaA__ACI06169__HA

SEQ ID NO: 2663 - RNA, 1701 nt, Artificial Sequence; identical to SEQ ID NO: 2580
  derived and/or modified CDS sequence (AUadapt) from InfluenzaA__ACI06171__HA

SEQ ID NO: 2664 - RNA, 1701 nt, Artificial Sequence; identical to SEQ ID NO: 2580
  derived and/or modified CDS sequence (AUadapt) from InfluenzaA__ACI06172__HA

SEQ ID NO: 2665 - RNA, 1701 nt, Artificial Sequence
  derived and/or modified CDS sequence (AUadapt) from InfluenzaA__ACI06173__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucggcagccgccccugggugcggggccuguccucgcgcaucuccaucuacuggaccaucgucaagcccggggacgugcucgagaucaacagcaacggcaaccugaucgcgccgcggggguacuucaagaugcgcaccggcaaguccucgaucaugcgguccgacgcccccaucgacacgugcaucucggagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucucggaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagucgggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 2666 - RNA, 1701 nt, Artificial Sequence; identical to SEQ ID NO: 2580
  derived and/or modified CDS sequence (AUadapt) from InfluenzaA__ACI06174__HA

SEQ ID NO: 2667 - RNA, 1701 nt, Artificial Sequence; identical to SEQ ID NO: 2581
  derived and/or modified CDS sequence (AUadapt) from InfluenzaA__ACI06175__HA

SEQ ID NO: 2668 - RNA, 1701 nt, Artificial Sequence; identical to SEQ ID NO: 2581
  derived and/or modified CDS sequence (AUadapt) from InfluenzaA__ACI06176__HA

SEQ ID NO: 2669 - RNA, 1701 nt, Artificial Sequence; identical to SEQ ID NO: 2581
  derived and/or modified CDS sequence (AUadapt) from InfluenzaA__ACI06177__HA

SEQ ID NO: 2670 - RNA, 1689 nt, Artificial Sequence
  derived and/or modified CDS sequence (AUadapt) from InfluenzaA__ACI25724__HA
auggccaucaucuaccugauccuccuguucgccaccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagcgcgagaacccccgguacucccucugcuacccgggcucgcugaacgacuacgaggagcugaagcaccuccuguccagcgugaagcacuucgagaaggugcgcauccugcccaaggaccgguggacgcagcacaccaccaccgggggcuccaaggccugcgccgucucggggaagcccuccuucuuccgcaacaugguguggcucacgaagaagggccccaacuacccgguggcgaaggggucguacaacaacaccuccggcgagcagaugcugaucaucuggggcguccaccaccccaaggacgaggccgagcagcgggcccuguaccaggagguggggaccuacgugucggccuccaccagcacgcucaacaagcgcuccauccccgagaucgcggcccggcccgaggucaacggccuggggucgcgcauggaguucuccuggacccugcucgacgugugggacaccaucaacuucgagucgaccggcaaccugguggccccggaguacggcuucaagaucuccaagcgggggucgagcggcaucaugaagacggaggggacccugggcaacugcgagaccaagugccagacgccccucggggccaucaacaccacccugcccuuccacaacguccacccccugaccaucggcgagugcccgaaguacgugaaguccgagaagcucgugcuggccaccggccugcgcaacgucccccagaucgagucgcggggccucuucggggcgaucgccggguucaucgagggcggguggcagggcaugguggacggcugguacggguaccaccacuccaacgaccagggcucgggguacgccgccgacaaggaguccacgcagaaggccuucgacggcaucaccaacaaggugaacucggucaucgagaagaugaacacccaguucgaggcgguggggaaggaguucaacaaccuggagaagcgccuggagaaccucaacaagaagauggaggacggcuuccuggacguguggaccuacaacgccgagcugcucguccugauggagaacgagcggacgcuggacuuccacgacuccaacgugaagaaccucuacgagaagguccgcaugcagcugcgggacaacgugaaggagcugggcaacgggugcuucgaguucuaccacaagugcgacgacgagugcaugaacagcgugaagaacggcaccuacgacuaccccaaguacgaggaggaguccaagcucaagcgcaacgagaucaagggggucaagcugucguccaugggcguguaccagauccuggccaucuacgccaccguggccggcucgcucucccuggcgaucauggucgccgggaucucguucuggaugugcuccaacggcagccugcagugccggaucugcaucuga

SEQ ID NO: 2671 - RNA, 1701 nt, Artificial Sequence
  derived and/or modified CDS sequence (AUadapt) from InfluenzaA__ACI25746__HA
augaagaccaucaucgcccugucguacaucuucugccucgcccugggccaguaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucggcagccgccccugggugcggggccuguccucgcgcaucuccaucuacuggaccaucgucaagcccggggacgugcucgugaucgacagcaacggcaaccugaucgcgccgcggggguacuucaagaugcgcaccggcaaguccucgaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacucggaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacucggagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 2672 - RNA, 1701 nt, Artificial Sequence
  derived and/or modified CDS sequence (AUadapt) from InfluenzaA__ACI25757__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccuggugcucaacgucacgaugcccaacaacgacaacuucgacaagcuguacaucuggggcgugcaccaccccucgaccaaccaggagcagaccucccuguacgugcaggccagcgggcgggucaccguguccacgcgccggucgcagcagaccaucaucccgaacaucggcagccgccccugggugcggggccucuccucgcgcaucuccaucuacuggaccaucgucaagcccggggacgugcuggugaucaacagcaacggcaaccugaucgcgccccggggguacuucaagaugcgcaccggcaaguccucgaucaugcgguccgacgccccgaucgacacgugcaucagcgagugcaucacccccaacggguccauccccaacgacaagcccuuccagaacgucaacaagaucaccuacggcgccugcccgaaguacgugaagcagaacacccucaagcuggccacgggcaugcgcaacgugcccgagaagcagacccgggggcuguucggcgccaucgcgggguucaucgagaacggcugggaggggaugaucgacggcugguacggcuuccgccaccagaacucggaggggaccggccaggccgccgaccucaaguccacccaggccgccaucgaccagaucaacgggaagcugaaccgggucaucgagaagacgaacgagaaguuccaccagaucgagaaggaguucagcgagguggagggccgcauccaggaccuggagaaguacguggaggacaccaagaucgaccucugguccuacaacgcggagcugcuggucgcccucgagaaccagcacaccaucgaccugaccgacucggagaugaacaagcuguucgagaagacgcggcgccagcuccgggagaacgccgaggacauggggaacggcugcuucaagaucuaccacaagugcgacaacgccugcaucgaguccauccgcaacggcaccuacaaccacgacguguaccgcgacgaggcccugaacaaccgguuccagaucaagggggucgagcucaagagcggcuacaaggacuggauccuguggaucuccuucgcgaucagcugcuuccugcugugcguggugcuccugggguucaucaugugggccugccagcgcggcaacauccggugcaacaucugcaucuga

SEQ ID NO: 2673 - RNA, 1701 nt, Artificial Sequence; identical to SEQ ID NO: 2561
  derived and/or modified CDS sequence (AUadapt) from InfluenzaA__ACI25768__HA

SEQ ID NO: 2674 - RNA, 1701 nt, Artificial Sequence
  derived and/or modified CDS sequence (AUadapt) from InfluenzaA__ACI25779__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcucgggcuucuucucccgccucaacuggcugaccaagagcggguccaccuaccccgugcugaacgucacgaugcccaacaacgacaacuucgacaagcucuacaucuggggcgugcaccacccgucgaccaaccaggagcagaccucccuguacgugcaggccagcgggcgggucaccguguccacgcgccggucgcagcagaccaucauccccaacaucuggagccgccccugggugcggggccuguccucgcgcaucuccaucuacuggaccaucgucaagcccggcgacgugcucgugaucaacagcaacgggaaccugaucgcgccgcggggcuacuucaagaugcgcaccgggaaguccucgaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacucggagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacucggagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 2675 - RNA, 1701 nt, Artificial Sequence
  derived and/or modified CDS sequence (AUadapt) from InfluenzaA__ACI25790__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccucgaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcucgcuggucgccuccagcggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucuggucgcgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccucgaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacucggagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacucggagaugaacaagcuguucgagaagacgcggcgccagcugcgggagaacgccgaggacaugggcaacgggugcuucaagaucuaccacaagugcgacaacgccugcaucgaguccauccgcagcggcaccuacgaccacgacguguaccgcgacgaggcccucaacaaccgguuccagaucaagggcgucgagcugaaguccggguacaaggacuggauccuguggaucagcuucgcgaucuccugcuuccuccugugcguggugcugcucggcuucaucaugugggccugccagcgcgggaacauccggugcaacaucugcaucuga

SEQ ID NO: 2676 - RNA, 1701 nt, Artificial Sequence
  derived and/or modified CDS sequence (AUadapt) from InfluenzaA__ACI25801__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucaacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgaggacuucaccuggacgggggugacccagaacggcggguccaacgccugcaagcggggccccgggagcggcuucuucucccgccucaacuggcugaccaagucgggcuccaccuaccccgugcuggacgucacgaugcccaacaacgacaacuucgacaagcucuacaucuggggcgugcaccacccgagcaccaaccaggagcagaccucccuguacgugcaggccucggggcgggucaccguguccacgcgccggagccagcagaccaucauccccaacaucgggucgcgccccugggugcggggccuguccagccgcaucuccaucuacuggaccaucgucaagcccggcgacgugcucgugaucaacucgaacgggaaccugaucgcgccgcggggcuacuucaagaugcgcaccgggaaguccagcaucaugcgguccgacgcccccaucgacacgugcaucucggagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucucggagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagucgggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 2677 - RNA, 1689 nt, Artificial Sequence; identical to SEQ ID NO: 2595
  derived and/or modified CDS sequence (AUadapt) from InfluenzaA__ACI26274__HA

SEQ ID NO: 2678 - RNA, 1698 nt, Artificial Sequence
  derived and/or modified CDS sequence (AUadapt) from InfluenzaA__ACI26307__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccucgaccggggagaucugcgacagcccccaccagauccucgacggcgagaacugcacgcugaucgacgcccugcucggggacccccagugcgacggcuuccagaacaagaagugggaccuguucguggagcgcucgaaggccuacuccaacugcuaccccuacgacgugccggacuacgccagccugcggucccucgucgcgucguccggcacccuggaguucaacaacgagagcuucaacuggaccggggugacccagaacggcacguccucggccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgugaccgacaacgaccagaucuuccuguacgcccagucggggcggaucacgguguccaccaagcgcagccagcagaccgucaucccgaacaucgggucgcggccccgcgugcggaacucccccagccgcaucuccaucuacuggaccaucgugaagcccggcgacauccugcucaucaacucgacgggcaaccugaucgcgccgcggggguacuucaagauccgcuccggcaagagcuccaucaugcggucggacgcccccaucgggaagugcaacuccgagugcaucacccccaacggcagcauccccaacgacaagccguuccagaacgucaaccgcaucaccuacggcgccugcccccgguacgugaagcagaacacccugaagcucgccacggggaugcgcaacgugcccgagaagcagacccggggcaucuucggggccaucgcgggcuucaucgagaacgggugggagggcauggucgacggcugguacggguuccgccaccagaacuccgagggcaucgggcaggccgccgaccugaaguccacccaggccgccaucgaccagaucaacggcaagcugaaccggcucaucgggaagaccaacgagaaguuccaccagaucgagaaggaguucuccgagguggagggccgcauccaggaccuggagaaguacguggaggacacgaagaucgaccuguggucguacaacgcggagcuccuggucgcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgccugcaucggcagcauccgcaacgggacguacgaccacgacguguaccgcgacgaggcccucaacaaccgguuccagaucaagggcguggagcugaaguccggguacaaggacuggauccuguggaucagcuucgcgaucuccugcuuccuccugugcgucgcccugcucggcuucaucaugugggccugccagaagggcaacauccgcugcaacaucugcaucuga

SEQ ID NO: 2679 - RNA, 1701 nt, Artificial Sequence
  derived and/or modified CDS sequence (AUadapt) from InfluenzaA__ACI26362__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2680 - RNA, 1701 nt, Artificial Sequence
  derived and/or modified CDS sequence (AUadapt) from InfluenzaA__ACI26373__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacugggccggggugacccagaacggcaccuccucggccugcauccgcaaguccaacaacagcuucuucucccggcugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccucggggcgcaucaccguguccaccaagcggagccagcagacggugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacucggaggggcgcggccaggccgcggaccugaaguccacgcaggccgccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgggagaacgcggaggacauggggaacggcugcuucaagaucuaccacaagugcgacaacgccugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggcgugccagaaggggaacauccgcugcaacaucugcaucuga

SEQ ID NO: 2681 - RNA, 1701 nt, Artificial Sequence; identical to SEQ ID NO: 2546
  derived and/or modified CDS sequence (AUadapt) from InfluenzaA__ACI26395__HA

SEQ ID NO: 2682 - RNA, 1701 nt, Artificial Sequence
  derived and/or modified CDS sequence (AUadapt) from InfluenzaA__ACI26406__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaagcaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 2683 - RNA, 1701 nt, Artificial Sequence; identical to SEQ ID NO: 2173
  derived and/or modified CDS sequence (AUadapt) from InfluenzaA__ACI26417__HA

SEQ ID NO: 2684 - RNA, 1701 nt, Artificial Sequence
  derived and/or modified CDS sequence (AUadapt) from InfluenzaA__ACI26428__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacucgccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggucgcucgucgccuccagcgggacgcuggaguucaacaacgaguccuucaacuggaccggcgugacccagaacgggaccucguccagcugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgugaccgacaacgaccagauccggcuguacgcccaggcgagcgggcgcaucaccguguccacgaagcggucgcagcagaccgucaucccgaacaucggcuaccgcccccgggugcgcgacauccccagccggaucuccaucuacuggaccaucgugaagcccggcgacauccugcucaucaacucgaccgggaaccugaucgccccgcgcggcuacuucaagauccgguccggcaagagcuccaucaugcgcucggacgcccccaucgggaagugcaacuccgagugcaucacgcccaacggcagcauccccaacgacaagccguuccagaacgucaaccggaucaccuacggggccugcccccgcuacgugaagcagaacacccugaagcucgccaccggcaugcggaacgugcccgagaagcagacgcgcgggaucuucggcgcgaucgccggguucaucgagaacggcugggagggcauggucgacgggugguacggcuuccggcaccagaacuccgaggggaucggccaggccgccgaccucaagucgacccaggccgcgaucaaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcaccaagaagcagcugcgcgagaacgccgaggacauggggaacggcugcuucaagaucuaccacaagugcgacaacgccugcaucgggucgauccggaacggcaccuacgaccacgacguguaccgcgacgaggcgcucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 2685 - RNA, 1698 nt, Artificial Sequence
  derived and/or modified CDS sequence (AUadapt) from InfluenzaA__ACI26439__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcaaccagcgcgcccuguaccacaccgagaacgccuacgugagcgucgugucgucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacucgaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgucaagcucgagagcaugggcguguaccagauccuggccaucuacucgaccguggccuccagccugguccuccuggugucccugggggccaucagcuucuggaugugcuccaacggcagccuccagugccggaucugcaucuga

SEQ ID NO: 2686 - RNA, 1698 nt, Artificial Sequence; identical to SEQ ID NO: 2685
  derived and/or modified CDS sequence (AUadapt) from InfluenzaA__ACI26450__HA

SEQ ID NO: 2687 - RNA, 1701 nt, Artificial Sequence
  derived and/or modified CDS sequence (AUadapt) from InfluenzaA__ACI26461__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcuccaaggccuacuccaacugcuaccccuacgacgugccggacuacgccagccugcggucccucgucgcgucguccggcacccuggaguucaacaacgagagcuucaacuggaccggggugacccagaacggcacguccucggccugcauccgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucuucccguacgcccaggcgagcgggcggaucacgguguccaccaagcgcucgcagcagaccgugauccccaacaucggcagccggccccgcguccggaacauccccucccgcaucucgaucuacuggaccaucgugaagccgggcgacauccugcugaucaacuccacggggaaccucaucgcgccccggggcuacuucaagauccgcagcgggaaguccucgaucaugcgguccgacgcccccaucggcaagugcaacucggagugcaucacccccaacggcuccaucccgaacgacaagcccuuccagaacgugaaccgcaucaccuacggggccugcccccgguacgucaagcagaacacccugaagcuggccacgggcaugcgcaacgugcccgagaagcagacccgggggaucuucggcgccaucgccggguucaucgagaacggcugggagggcaugguggacgggugguacggcuuccgccaccagaacagcgaggggaucggccaggccgccgaccucaaguccacccaggccgcgaucgaccagaucaacgggaagcugaaccggcugaucggcaagaccaacgagaaguuccaccagaucgagaaggaguucucggaggucgagggccgcauccaggaccucgagaaguacguggaggacacgaagaucgaccugugguccuacaacgccgagcugcucguggcccuggagaaccagcacaccaucgaccugaccgacagcgagaugaacaagcuguucgagaagaccaagaagcagcuccgggagaacgccgaggacauggggaacggcugcuucaagaucuaccacaagugcgacaacgccugcaucggguccauccgcaacggcacguacgaccacaacgucuaccgcgacgaggcgcugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 2688 - RNA, 1698 nt, Artificial Sequence
  derived and/or modified CDS sequence (AUadapt) from InfluenzaA__ACI26472__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccucgaccggggagaucugcgacagcccccaccagauccucgacggcgagaacugcacgcugaucgacgcccugcucggggacccccagugcgacggcuuccagaacaagaagugggaccuguucguggagcgcucgaaggccuacuccaacugcuaccccuacgacgugccggacuacgccagccugcggucccucgucgcgucguccggcacccuggaguucaacaacgagagcuucaacuggaccggggugacccagaacggcacguccucggccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgugaccgacaacgaccagaucuuccuguacgcccagagcgggcggaucacgguguccaccaagcgcucgcagcagaccgucaucccgaacaucggguaccggccccgcgugcggaacauccccagccgcaucuccaucuacuggaccaucgugaagcccggcgacauccugcucaucaacucgacgggcaaccugaucgcgccgcggggguacuucaagauccgcuccggcaagagcuccaucaugcggucggacgcccccaucgggaagugcaacuccgagugcaucacccccaacggcagcauccccaacgacaagccguuccagaacgucaaccgcaucaccuacggcgccugcccccgguacgugaagcagaacacccugaagcucgccacggggaugcgcaacgugcccgagaagcagacccggggcaucuucggggccaucgcgggcuucaucgagaacgggugggagggcauggucgacggcugguacggguuccgccaccagaacuccgagggcaucgggcaggccgccgaccugaaguccacccaggccgccaucgaccagaucaacggcaagcugaaccggcucaucgggaagaccaacgagaaguuccaccagaucgagaaggaguucuccgagguggagggccgcauccaggaccuggagaaguacguggaggacacgaagaucgaccuguggucguacaacgcggagcuccuggucgcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgccugcaucggcagcauccgcaacgggacguacgaccacgacguguaccgcgacgaggcccucaacaaccgguuccagaucaagggcguggagcugaaguccggguacaaggacuggauccuguggaucagcuucgcgaucuccugcuuccuccugugcgucgcccugcucggcuucaucaugugggccugccagaagggcaacauccgcugcaacaucugcaucuga

SEQ ID NO: 2689 - RNA, 1701 nt, Artificial Sequence; identical to SEQ ID NO: 2680
  derived and/or modified CDS sequence (AUadapt) from InfluenzaA__ACI26483__HA

SEQ ID NO: 2690 - RNA, 1701 nt, Artificial Sequence
  derived and/or modified CDS sequence (AUadapt) from InfluenzaA__ACI26505__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacugggccggggugacccagaacggcaccuccucggccugcauccgcaaguccaacaacagcuucuucucccggcugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccucggggcgcaucaccguguccaccaagcggagccagcagacggugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacucggaggggcgcggccaggccgcggaccugaaguccacgcaggccgccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgggagaacgcggaggacauggggaacggcugcuucaagaucuaccacaagugcgacaacgccugcauccgcuccauccgcaacgggaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggcgugccagaagggcaacauccggugcaacaucugcaucuga

SEQ ID NO: 2691 - RNA, 1701 nt, Artificial Sequence; identical to SEQ ID NO: 2679
  derived and/or modified CDS sequence (AUadapt) from InfluenzaA__ACI26516__HA

SEQ ID NO: 2692 - RNA, 1701 nt, Artificial Sequence; identical to SEQ ID NO: 2680
  derived and/or modified CDS sequence (AUadapt) from InfluenzaA__ACI26527__HA

SEQ ID NO: 2693 - RNA, 1701 nt, Artificial Sequence
  derived and/or modified CDS sequence (AUadapt) from InfluenzaA__ACI26538__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgacaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 2694 - RNA, 1701 nt, Artificial Sequence
  derived and/or modified CDS sequence (AUadapt) from InfluenzaA__ACI26549__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacgagaagugggaccuguucguggagcgcucgaaggccuacuccaacugcuaccccuacgacgugccggacuacgcgagccugcggucccucgucgccucguccggcacgcuggaguucaucaacgaggacuucaacuggaccggggugacccagagcggcggguccuacagcugcaagcgcggcuccgugaacucguucuucucccggcugaacuggcuccacgagagcgaguacaaguaccccgcccugaacgucaccaugcccaacaacgggaaguucgacaagcuguacaucuggggcgugcaccaccccuccacggaccgcgagcagaccaagcucuacgugcgggccucgggccgcgucaccgugagcaccaagcggucccagcagacggugaucccgaacaucgggucgcgccccuggguccggggccuguccagccgcaucuccaucuacuggaccaucgugaagcccggggacauccugcucaucaacagcaccggcaaccugaucgcgccccggggcuacuucaagauccgcaccgggaaguccucgaucaugcgguccgacgccccgaucggcacgugcagcuccgagugcaucacccccaacgggucgauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgcgggguucaucgagaacggcugggaggggaugguggacggcugguacggguuccggcaccagaacuccgagggcaccggccaggccgccgaccugaaguccacccaggccgccaucgaccagaucaacgggaagcugaaccgccucaucgagaagacgaacgagaaguuccaccagaucgagaaggaguucuccgaggucgagggccggauccaggaccuggaggaguacguggaggacaccaagaucgaccuguggagcuacaacgcggagcuccugguggcccuggagaaccagcacaccaucgaccucaccgacuccgagaugaacaagcuguucgagaagacgcgcaagcagcugcgcgagaacgccgaggacauggggaacggcugcuucaagaucuaccacaagugcgacaacgccugcaucgggucgauccggaacggcaccuacgaccacgacgucuaccgcgacgaggcccucaacaaccgguuccagaucaagggcguggagcugaaguccggguacaaggacuggauccuguggaucagcuucgcgaucagcugcuuccuccugugcgucgugcugcucggcuucaucaugugggccugccagaaggggaacauccgcugcaacaucugcaucuga

SEQ ID NO: 2695 - RNA, 1701 nt, Artificial Sequence
  derived and/or modified CDS sequence (AUadapt) from InfluenzaA__ACI26560__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccagcuccggcacgcuggaguucaucaacgaggacuucaacuggaccgggguggcccagucgggcggguccuacgccugcaagcgcggcagcgugaacuccuucuucucgcggcugaacuggcuccacgaguccgaguacaaguaccccgcgcugaacgucaccaugcccaacaacgggaaguucgacaagcuguacaucuggggcgugcaccaccccaucaccgaccgcgagcagacgaaccucuacgugcgggccagcggccgcgucaccguguccaccaagcggucgcagcagaccgugaucccgaacaucgggagccgccccuggguccggggccuguccagccgcaucuccaucuacuggacgaucgugaagcccggggacauccugcucaucaacucgaccggcaaccugaucgcgccccggggcuacuucaagauccgcaccgggaaguccagcaucaugcgguccgacgccccgaucgggaccugcucguccgagugcaucacgcccaacggcagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacuccgagggcaccggccaggccgccgaccugaaguccacccaggcggccaucgaccagaucaacgggaagcugaaccggcucaucgagaagaccaacgagaaguuccaccagaucgagaaggaguucuccgaggucgagggccgcauccaggaccuggagaaguacguggaggacacgaagaucgaccuguggucguacaacgccgagcuccugguggcccuggagaaccagcacaccaucgaccucaccgacuccgagaugaacaagcuguucgagaagacccgcaagcagcugcgggagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagaaggggaacauccggugcaacaucugcaucuga

SEQ ID NO: 2696 - RNA, 1701 nt, Artificial Sequence
  derived and/or modified CDS sequence (AUadapt) from InfluenzaA__ACI26571__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccucgaccgggcgcaucugcgacagcccccaccggauccucgacggcaagaacugcacccugaucgacgcccugcucggggacccccacugcgacggcuuccagaacaaggagugggaccuguucguggagcgcucgaaggccuacuccaacugcuaccccuacgacgugccggacuacgcgagccugcggucccucgucgccucguccggcacgcuggaguucaucaacgaggacuucaacuggaccgggguggcccagagcggcggguccuacgccugcaagcgcggcucggugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaagcucuacgugcgggccuccggccgcgucaccgugucgaccaagcggagccagcagaccgugaucccgaacaucgggucccgccccuggguccggggccugucgucccgcaucagcaucuacuggacgaucgugaagcccggggacauccugcucaucaacuccaccggcaaccugaucgcgccccggggcuacuucaagauccgcaccggcaagucguccaucaugcggagcgacgccccgaucgggaccugcuccucggagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacaaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 2697 - RNA, 1701 nt, Artificial Sequence
  derived and/or modified CDS sequence (AUadapt) from InfluenzaA__ACI26593__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgucgcuccggucccuggucgccagcuccggcacgcuggaguucaccaacgaggacuucaacuggaccgggguggcccagucgggcgaguccuacgccugcaagcgcgggagcgugaaguccuucuucucgcggcucaacuggcugcacaaguccgacuacaaguaccccgcgcugaacgucaccaugcccaacaacggcaaguucgacaagcucuacaucuggggcgugcaccaccccagcacggaccgcgagcagaccucccuguacgugcgggccucggggcgcgucaccgugagcaccaagcggucccagcagacggugaucccgaacaucggcucgcgccccuggguccgggggcuguccagccgcaucuccaucuacuggaccaucgugaagcccggcgacauccuccugaucaacucgaccgggaaccugaucgcgccccggggcuacuucaagauccgcaccggcaaguccagcaucaugcgguccgacgccccgaucgggacgugcucguccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggucguacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcugaaguccggcuacaaggacuggauccucuggaucucguucgccaucagcugcuuccugcugugcgucgugcuccugggguucaucaugugggccugccagaagggcaacauccggugcaacaucugcaucuga

SEQ ID NO: 2698 - RNA, 1698 nt, Artificial Sequence
  derived and/or modified CDS sequence (AUadapt) from InfluenzaA__ACI32715__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagucgcgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacaccgugaucgagaagaugaacacgcaguucaccgccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagucgaagcucaaccgcgagaagaucgacggcgugaagcuggaguccaugggcguguaccagauccuggccaucuacagcaccgucgccagcucccucgugcugcuggugagccucggggccaucuccuucuggaugugcagcaacggcucccugcagugccggaucugcaucuga

SEQ ID NO: 2699 - RNA, 1698 nt, Artificial Sequence
  derived and/or modified CDS sequence (AUadapt) from InfluenzaA__ACI32716__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcucgggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacucggugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagucgaugggcguguaccagauccuggccaucuacagcacggucgccuccagccucgugcugcuggugucccucggggccaucagcuucuggaugugcuccaacggcagccugcagugcaccaucugcaucuga

SEQ ID NO: 2700 - RNA, 1698 nt, Artificial Sequence
  derived and/or modified CDS sequence (AUadapt) from InfluenzaA__ACI32717__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaugaacagcucccugcccuuccagaacguccacccggugaccaucggcgagugccccaaguacgugcggagcgccaagcugcgcauggccaccgggcuccggaacauccccuccauccagucgcgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacucggaggaguccaagcucaaccgcgagaagaucgacggcgugaagcuggagagcaugggcguguaccagauccuggccaucuacagcacggucgccuccagccucgugcugcuggugucccucggggccaucaacuucuggaugugcagcaacggcucccugcagugcaagaucugcaucuga

(The sequence listing continues in the following parts.)

The invention claimed is:

1. A method for analysis or purification of a mixture comprising at least two harmonized RNA species, the method comprising:
   a) obtaining the coding sequences for at least two RNA species, said at least two RNA species each having a length of 800 to 20,000 nucleotides wherein the sequence of at least one RNA species is adapted by altering the number of A and/or U nucleotides in the RNA sequence with respect to the number of A and/or U nucleotides in the original RNA sequence, said coding sequences of the at least two RNA species having a harmonized number of encoded A and U nucleotides that is no more than 50 different from each other;
   b) synthesizing the at least two RNA species to produce at least two harmonized RNA species; and c) analysing and/or purifying a mixture of said at least two harmonized RNA species by chromatography.

2. The method according to claim 1, wherein step b) comprises the separate synthesis of the at least two harmonized RNA species.

3. The method according to claim 2, wherein step b) comprises mixing the at least two harmonized RNA species.

4. The method according to claim 1, wherein step b) comprises the synthesis of the at least two harmonized RNA species in one batch.

5. The method according to claim 1, wherein step b) comprises an in vitro transcription step.

6. The method according to claim 1, wherein at least one RNA species comprises at least 500 nucleotides.

7. The method according to claim 6, wherein the at least two RNA species are mRNAs.

8. The method according to claim 7, wherein the at least two RNA species each comprise a 5'-cap structure.

9. The method according to claim 8, wherein the at least two RNA species each comprise, in 5' to 3' direction, the following elements:
   a) a 5'-cap structure
   b) optionally, a 5'-UTR element,
   c) at least one coding region;
   d) a 3'-UTR element, and
   e) a poly(A) sequence comprising 10 to 200.

10. The method according to claim 8, wherein the at least two RNA species each encode different Influenza virus hemagglutinin (HA) antigens.

11. The method according to claim 8, wherein the at least two RNA species each comprise a coding region, wherein the coding region has an increased G/C content compared to the G/C content of an original coding sequence, wherein the encoded amino acid sequence is not modified compared to the amino acid sequence encoded by the corresponding original mRNA.

12. The method according to claim 8, wherein the method is applied to at least three RNA species.

13. The method according to claim 12, wherein the at least three RNA species encode different influenza HA antigens.

14. The method according to claim 1, comprising:
   c) analysing the mixture of said at least two harmonized RNA species by chromatography.

15. The method according to claim 1, wherein the chromatography comprises HPLC.

16. The method according to claim 15, wherein the chromatography comprises reversed phase HPLC.

17. The method according to claim 16, wherein the reversed phase HPLC is with a column that comprises a porous material, selected from the group consisting of polystyrene, a non-alkylated polystyrene, an alkylated polystyrene, a polystyrenedivinylbenzene, a non-alkylated polystyrenedivinylbenzene, an alkylated polystyrenedivinylbenzene, a silica gel, a silica gel modified with non-polar residues, a silica gel modified with alkyl containing residues, selected from butyl-, octyl and/or octadecyl containing residues, a silica gel modified with phenylic residues, and a polymethacrylate.

18. The method according to claim 8, wherein the at least two RNA species each encode different Influenza virus neuraminidase (NA) antigens.

19. The method according to claim 1, wherein the numbers of A and U nucleotides in the sequences of the at least two harmonized RNA species differ from each other by not more than 20.

20. The method according to claim 19, wherein the numbers of A and U nucleotides in the sequences of the at least two harmonized RNA species differ from each other by not more than 10.

21. The method according to claim 13, wherein the numbers of A and U nucleotides in the sequences of the at least two harmonized RNA species differ from each other by not more than 20.

22. The method according to claim 8, wherein the method is applied to at least four RNA species, wherein the at least four RNA species encode different influenza HA antigens.

* * * * *